US012214002B2

(12) United States Patent
Ford et al.

(10) Patent No.: US 12,214,002 B2
(45) Date of Patent: Feb. 4, 2025

(54) COMPOSITIONS AND METHODS FOR TREATING ANTIBIOTIC RESISTANCE

(71) Applicant: Seres Therapeutics, Inc., Cambridge, MA (US)

(72) Inventors: Christopher Burton Ford, Swampscott, MA (US); Jessica Bryant, Cambridge, MA (US); Edward J. O'Brien, Arlington, MA (US)

(73) Assignee: Seres Therapeutics, Inc., Cambridge, MA (US)

( * ) Notice: Subject to any disclaimer, the term of this patent is extended or adjusted under 35 U.S.C. 154(b) by 0 days.

(21) Appl. No.: 16/760,757

(22) PCT Filed: Oct. 30, 2018

(86) PCT No.: PCT/US2018/058279

§ 371 (c)(1),
(2) Date: Apr. 30, 2020

(87) PCT Pub. No.: WO2019/089643

PCT Pub. Date: May 9, 2019

(65) Prior Publication Data

US 2020/0353018 A1 Nov. 12, 2020

Related U.S. Application Data

(60) Provisional application No. 62/578,698, filed on Oct. 30, 2017, provisional application No. 62/741,346, filed on Oct. 4, 2018.

(51) Int. Cl.
*A61K 35/742* (2015.01)
*A61P 31/04* (2006.01)

(52) U.S. Cl.
CPC ............ *A61K 35/742* (2013.01); *A61P 31/04* (2018.01)

(58) Field of Classification Search
None
See application file for complete search history.

(56) References Cited

U.S. PATENT DOCUMENTS

| | | | |
|---|---|---|---|
| 3,009,861 | A | 11/1961 | Gordon et al. |
| 3,009,864 | A | 11/1961 | Webb |
| 3,228,838 | A | 1/1966 | Rinfret et al. |
| 3,608,030 | A | 9/1971 | Tint |
| 4,077,227 | A | 3/1978 | Larson |
| 4,205,132 | A | 5/1980 | Sandine et al. |
| 4,655,047 | A | 4/1987 | Temple et al. |
| 4,689,226 | A | 8/1987 | Nurmi et al. |
| 4,780,987 | A | 11/1988 | Nelsen et al. |
| 4,839,281 | A | 6/1989 | Gorbach et al. |
| 5,196,205 | A | 3/1993 | Borody |
| 5,425,951 | A | 6/1995 | Goodrich, Jr. et al. |
| 5,436,002 | A | 7/1995 | Payne et al. |
| 5,443,826 | A | 8/1995 | Borody |
| 5,599,795 | A | 2/1997 | McCann et al. |
| 5,648,206 | A | 7/1997 | Goodrich, Jr. et al. |
| 5,851,545 | A | 12/1998 | Fowler et al. |
| 5,951,977 | A | 9/1999 | Nisbet et al. |
| 5,965,128 | A | 10/1999 | Doyle et al. |
| 6,368,586 | B1 | 4/2002 | Jacob et al. |
| 6,589,771 | B1 | 7/2003 | Marshall |
| 6,645,530 | B1 | 11/2003 | Borody |
| 6,780,317 | B1 | 8/2004 | Uotila et al. |
| 7,326,551 | B2 | 2/2008 | Maupin-Furlow et al. |
| 7,427,398 | B2 | 9/2008 | Baillon et al. |
| 7,628,982 | B2 | 12/2009 | Klaviniskis et al. |
| 7,632,520 | B2 | 12/2009 | Khandelwal |
| 7,708,988 | B2 | 5/2010 | Farmer |
| 7,731,976 | B2 | 6/2010 | Cobb et al. |
| 7,763,420 | B2 | 7/2010 | Stritzker et al. |
| 7,981,411 | B2 | 7/2011 | Nadeau et al. |
| 7,998,473 | B2 | 8/2011 | Boileau et al. |
| 8,021,654 | B2 | 9/2011 | Rehberger et al. |
| 8,034,601 | B2 | 10/2011 | Boileau et al. |
| 8,039,006 | B2 | 10/2011 | Prato |
| 8,147,482 | B2 | 4/2012 | Shimizu et al. |
| 8,187,590 | B2 | 5/2012 | Farmer |
| 8,236,508 | B2 | 8/2012 | Mutharasan et al. |
| 8,388,996 | B2 | 3/2013 | Gehling et al. |
| 8,460,648 | B2 | 6/2013 | Borody |
| 8,906,668 | B2 | 12/2014 | Henn et al. |
| 8,968,721 | B2 | 3/2015 | Harel |
| 9,011,834 | B1 | 4/2015 | McKenzie et al. |
| 9,028,798 | B2 | 5/2015 | Weiner et al. |

(Continued)

FOREIGN PATENT DOCUMENTS

| | | |
|---|---|---|
| CN | 101264107 A | 9/2008 |
| CN | 102131928 A | 7/2011 |

(Continued)

OTHER PUBLICATIONS

Bathena, S. P. R., et al., "The profile of bile acids and their sulfate metabolites in human urine and serum," J Chromatogr B Analyt Technol Biomed Life Sci 942-943:53-62, Elsevier, Netherlands (published online Oct. 2013, published in print Dec. 2013).
Chazouillères, O., "Primary sclerosing cholangitis and bile acids," Clinics and Research in Hepatology and Gastroenterology 36(Suppl_1):S21-S25, Elsevier Masson, France (Sep. 2012).
Debruyne, P. R., et al., "The role of bile acids in carcinogenesis," Mutation Research/Fundamental and Molecular Mechanisms of Mutagenesis 480-481:359-369, Elsevier BV, Netherlands (Sep. 2001).
Deleuze, J. F., et al., "Defect of multidrug-resistance 3 gene expression in a subtype of progressive familial intrahepatic cholestasis," Hepatology 23(4): 904-908, John Wiley and Sons Ltd., United States (Apr. 1996).
Duboc, H., et al. "Connecting dysbiosis, bile-acid dysmetabolism and gut inflammation in inflammatory bowel diseases," Gut 62(4): 531-539, BMJ Publishing Group, United Kingdom (published online Sep. 2012, published in print Apr. 2013).

(Continued)

*Primary Examiner* — S. Devi
(74) *Attorney, Agent, or Firm* — Sterne, Kessler, Goldstein & Fox P.L.L.C.

(57) ABSTRACT

The present invention relates to compositions and methods for reducing the carriage of antibiotic resistance genes.

20 Claims, 4 Drawing Sheets

Specification includes a Sequence Listing.

(56) References Cited

U.S. PATENT DOCUMENTS 9,028,841 B2 5/2015 Henn et al.
9,180,147 B2 11/2015 McKenzie et al.
9,408,872 B2 8/2016 Borody
9,446,080 B2 9/2016 McKenzie et al.
9,533,014 B2 1/2017 Henn et al.
9,585,921 B2 3/2017 McKenzie et al.
9,610,307 B2 4/2017 Berry et al.
9,808,519 B2 11/2017 Honda et al.
9,855,303 B2 1/2018 McKenzie et al.
9,956,282 B2 5/2018 Cook et al.
9,962,415 B2 5/2018 Darimont-Nicolau et al.
10,064,900 B2 9/2018 Von et al.
10,064,901 B2 9/2018 McKenzie et al.
10,076,546 B2 9/2018 Henn et al.
10,238,694 B2 3/2019 Honda et al.
10,258,655 B2 4/2019 Henn et al.
10,646,520 B2 5/2020 Pamer et al.
10,864,235 B2 12/2020 Henn et al.
10,881,696 B2 1/2021 Henn et al.
10,967,011 B2 4/2021 McKenzie et al.
10,973,861 B2 4/2021 Afeyan et al.
11,185,562 B2 11/2021 Cook et al.
11,197,897 B2 12/2021 Pamer et al.
11,266,699 B2 3/2022 Henn et al.
11,389,490 B2 7/2022 Henn et al.
11,395,838 B2 7/2022 Wargo et al.
11,458,173 B2 10/2022 Henn et al.
11,458,174 B2 10/2022 Henn et al.
11,464,812 B2 10/2022 Henn et al.
11,471,495 B2 10/2022 Pamer et al.
11,597,979 B2 3/2023 Van Den Brink et al.
11,666,612 B2 6/2023 Henn et al.
11,701,394 B2 7/2023 Nandakumar et al.
11,730,775 B2 8/2023 McKenzie et al.
2001/0036453 A1 11/2001 Reid et al.
2004/0028689 A1 2/2004 Borody
2004/0170617 A1 9/2004 Finegold
2004/0175372 A1 9/2004 Park et al.
2004/0241772 A1 12/2004 Prato
2005/0048515 A1 3/2005 Garner
2005/0180962 A1 8/2005 Raz et al.
2005/0271643 A1 12/2005 Sorokulova et al.
2006/0046246 A1 3/2006 Zeng et al.
2006/0067924 A1 3/2006 Lee et al.
2006/0172330 A1 8/2006 Osborn et al.
2006/0188523 A1 8/2006 Pei et al.
2006/0233830 A1 10/2006 Wong et al.
2007/0141139 A1 6/2007 Vandenberg
2008/0213752 A1 9/2008 Stave et al.
2009/0197249 A1 8/2009 Gillevet
2009/0324638 A1 12/2009 Dattwyler et al.
2010/0074872 A1 3/2010 Blaser et al.
2010/0215745 A1 8/2010 Lazzari et al.
2011/0081320 A1 4/2011 Westall et al.
2011/0113863 A1 5/2011 Fuhrmann et al.
2011/0189132 A1 8/2011 Garner et al.
2011/0280840 A1 11/2011 Blaser et al.
2011/0280847 A1 11/2011 Sorg et al.
2012/0020950 A1 1/2012 Davis et al.
2012/0021429 A1 1/2012 Rublee et al.
2012/0021921 A1 1/2012 Scott et al.
2012/0058094 A1 3/2012 Blaser et al.
2012/0064592 A1 3/2012 O'Mullan et al.
2012/0128633 A1 5/2012 Veiga et al.
2012/0128634 A1 5/2012 Veiga et al.
2012/0148629 A1 6/2012 Holvoet et al.
2012/0149584 A1 6/2012 Olle et al.
2012/0165215 A1 6/2012 Andersen et al.
2012/0177650 A1 7/2012 Borody
2012/0207726 A1 8/2012 Lipkin et al.
2012/0238468 A1 9/2012 Tuk et al.
2012/0264637 A1 10/2012 Wiener-Kronish et al.
2012/0276149 A1 11/2012 Littman et al.
2012/0276201 A1 11/2012 Trachtman
2012/0278201 A1 11/2012 Milne
2012/0315249 A1 12/2012 Olmstead
2013/0017999 A1 1/2013 Fremont et al.
2013/0022575 A1 1/2013 Cassity
2013/0045274 A1 2/2013 Hlavka
2013/0045874 A1 2/2013 Ehrlich
2013/0065862 A1 3/2013 Johnson
2013/0115232 A1 5/2013 Ferrara et al.
2013/0121968 A1 5/2013 Quay
2013/0149339 A1 6/2013 Honda et al.
2013/0149375 A1 6/2013 Geall
2013/0195820 A1 8/2013 Wacklin et al.
2013/0266539 A1 10/2013 Borody
2014/0045744 A1 2/2014 Gordon et al.
2014/0135398 A1 5/2014 Matar et al.
2014/0147417 A1 5/2014 Sadowsky et al.
2014/0147425 A1 5/2014 Henn et al.
2014/0199281 A1 7/2014 Henn et al.
2014/0328803 A1 11/2014 McKenzie et al.
2014/0341921 A1 11/2014 Honda et al.
2014/0342438 A1 11/2014 Allen-Vercoe et al.
2014/0363397 A1 12/2014 Allen-Vercoe et al.
2015/0010960 A1 1/2015 Tamaru et al.
2015/0011415 A1 1/2015 Levin et al.
2015/0093360 A1 4/2015 McKenzie et al.
2015/0190435 A1 7/2015 Henn et al.
2016/0030494 A1 2/2016 Henn et al.
2016/0040215 A1 2/2016 Henn et al.
2016/0143962 A1 5/2016 Berry et al.
2016/0271188 A1 9/2016 Berry et al.
2016/0317653 A1 11/2016 Cook et al.
2017/0042860 A1 2/2017 Kashyap et al.
2017/0087196 A1 3/2017 Pamer et al.
2017/0165302 A1 6/2017 Henn et al.
2017/0258854 A1 9/2017 Van Den Brink et al.
2018/0200308 A1 7/2018 Cook et al.
2018/0369297 A1 12/2018 Karlsson et al.
2019/0070225 A1 3/2019 Strandwitz et al.
2019/0192581 A1 6/2019 Von Maltzahn et al.
2019/0247447 A1 8/2019 Button et al.
2019/0255124 A1 8/2019 Ruvkun et al.
2019/0381113 A1 12/2019 Pamer et al.
2020/0113989 A1 4/2020 Gunn et al.
2020/0206284 A1* 7/2020 Schneider ................ A61K 9/48
2020/0276249 A1 9/2020 O'Brien et al.
2020/0353018 A1* 11/2020 Ford .................... A61K 35/742
2021/0008128 A1 1/2021 Nandakumar et al.
2021/0121505 A1 4/2021 Nandakumar et al.
2021/0169946 A1 6/2021 Henn et al.
2021/0169947 A1 6/2021 Henn et al.
2021/0169948 A1 6/2021 Henn et al.
2021/0169949 A1 6/2021 Henn et al.
2021/0196766 A1 7/2021 Martinez et al.
2021/0244774 A1 8/2021 McKenzie et al.
2021/0252079 A1 8/2021 Matthew et al.
2021/0299191 A1 9/2021 Afeyan et al.
2021/0361721 A1 11/2021 Wortman et al.
2022/0017853 A1 1/2022 Evans et al.
2022/0096567 A1 3/2022 Pamer et al.
2022/0249578 A1 8/2022 Cook et al.
2022/0257674 A1 8/2022 Henn et al.
2023/0109343 A1 4/2023 Wargo et al.
2023/0125810 A1 4/2023 Martinez et al.
2023/0190825 A1 6/2023 Pamer et al.
2023/0226126 A1 7/2023 Henn et al.

FOREIGN PATENT DOCUMENTS

CN 102940652 A 2/2013
CN 102940652 B 3/2015
DE 102006062250 A1 6/2008
EA 006847 B1 4/2006
EP 0033584 A3 4/1982
EP 0446069 A1 9/1991
EP 0456418 A2 11/1991
EP 0433299 A4 4/1992
EP 0479820 B1 9/1994
EP 1107772 B1 4/2006
EP 1631312 B1 9/2008
EP 2337569 A2 6/2011

(56) References Cited

FOREIGN PATENT DOCUMENTS

| | | | |
|---|---|---|---|
| EP | 2338989 | A1 | 6/2011 |
| EP | 2519108 | A1 | 11/2012 |
| EP | 2626076 | A1 | 8/2013 |
| EP | 2684469 | A1 | 1/2014 |
| EP | 2750682 | B1 | 5/2016 |
| JP | H0656679 | A | 3/1994 |
| JP | 2007332083 | A | 12/2007 |
| JP | 2008532558 | A | 8/2008 |
| JP | 2010280640 | A | 12/2010 |
| JP | 2010539179 | A | 12/2010 |
| JP | 5019563 | B2 | 9/2012 |
| JP | 2012523852 | A | 10/2012 |
| RU | 2035186 | C1 | 5/1995 |
| RU | 2272793 | C2 | 3/2006 |
| RU | 2439145 | C2 | 1/2012 |
| RU | 2536939 | C2 | 12/2014 |
| WO | WO-9001335 | A1 | 2/1990 |
| WO | WO-9408598 | A1 | 4/1994 |
| WO | WO-9709886 | A1 | 3/1997 |
| WO | WO-9826787 | A1 | 6/1998 |
| WO | WO-9919459 | A1 | 4/1999 |
| WO | WO-0010582 | A2 | 3/2000 |
| WO | WO-0193904 | A1 | 12/2001 |
| WO | WO-0207741 | A1 | 1/2002 |
| WO | WO-0243649 | A2 | 6/2002 |
| WO | WO-2004069156 | A2 | 8/2004 |
| WO | WO-2005017095 | A2 | 2/2005 |
| WO | WO-2005110445 | A2 | 11/2005 |
| WO | WO-2006012586 | A2 | 2/2006 |
| WO | WO-2006099699 | A1 | 9/2006 |
| WO | WO-2007036230 | A1 | 4/2007 |
| WO | WO-2007136553 | A2 | 11/2007 |
| WO | WO-2008076696 | A2 | 6/2008 |
| WO | WO-2008077614 | A2 | 7/2008 |
| WO | WO-2008083157 | A2 | 7/2008 |
| WO | WO-2010030997 | A1 | 3/2010 |
| WO | WO-2010062369 | A2 | 6/2010 |
| WO | WO-2010081126 | A2 | 7/2010 |
| WO | WO-2010123932 | A1 | 10/2010 |
| WO | WO-2010124387 | A1 | 11/2010 |
| WO | WO-2010151842 | A2 | 12/2010 |
| WO | WO-2011005756 | A1 | 1/2011 |
| WO | WO-2011022542 | A2 | 2/2011 |
| WO | WO-2011022660 | A1 | 2/2011 |
| WO | WO-2011033310 | A1 | 3/2011 |
| WO | WO-2011043654 | A1 | 4/2011 |
| WO | WO-2011046616 | A2 | 4/2011 |
| WO | WO-2011060123 | A1 | 5/2011 |
| WO | WO-2011094027 | A1 | 8/2011 |
| WO | WO-2011103123 | A2 | 8/2011 |
| WO | WO-2011107481 | A2 | 9/2011 |
| WO | WO-2011107482 | A2 | 9/2011 |
| WO | WO-2011113801 | A1 | 9/2011 |
| WO | WO-2011152566 | A2 | 12/2011 |
| WO | WO-2012009712 | A2 | 1/2012 |
| WO | WO-2012016287 | A2 | 2/2012 |
| WO | WO-2012033814 | A2 | 3/2012 |
| WO | WO-2012045150 | A1 | 4/2012 |
| WO | WO-2012064981 | A2 | 5/2012 |
| WO | WO-2012108830 | A1 | 8/2012 |
| WO | WO-2012112478 | A1 | 8/2012 |
| WO | WO-2012116289 | A2 | 8/2012 |
| WO | WO-2012122478 | A1 | 9/2012 |
| WO | WO-2012122522 | A2 | 9/2012 |
| WO | WO-2012142605 | A1 | 10/2012 |
| WO | WO-2012148991 | A1 | 11/2012 |
| WO | WO-2012159023 | A2 | 11/2012 |
| WO | WO-2013016636 | A1 | 1/2013 |
| WO | WO-2013019896 | A1 | 2/2013 |
| WO | WO-2013032328 | A1 | 3/2013 |
| WO | WO-2013037067 | A1 | 3/2013 |
| WO | WO-2013037068 | A1 | 3/2013 |
| WO | WO-2013050792 | A1 | 4/2013 |
| WO | WO-2013053836 | A1 | 4/2013 |
| WO | WO-2013080561 | A1 | 6/2013 |
| WO | WO-2013121573 | A1 | 8/2013 |
| WO | WO-2013166031 | A1 | 11/2013 |
| WO | WO-2013171515 | A1 | 11/2013 |
| WO | WO-2013176774 | A1 | 11/2013 |
| WO | WO-2013177596 | A2 | 11/2013 |
| WO | WO-2014082050 | A1 | 5/2014 |
| WO | WO-2014088982 | A1 | 6/2014 |
| WO | WO-2014121298 | A2 | 8/2014 |
| WO | WO-2014121301 | A1 | 8/2014 |
| WO | WO-2014121302 | A2 | 8/2014 |
| WO | WO-2014121304 | A1 | 8/2014 |
| WO | WO-2014145958 | A2 | 9/2014 |
| WO | WO-2014153194 | A2 | 9/2014 |
| WO | WO-2014177667 | A1 | 11/2014 |
| WO | WO-2015018307 | A1 | 2/2015 |
| WO | WO-2015077794 | A1 | 5/2015 |
| WO | WO-2015095241 | A2 | 6/2015 |
| WO | WO-2017008026 | A1 | 1/2017 |
| WO | WO-2017074257 | A1 | 5/2017 |
| WO | WO 2017/091783 | A2 * | 6/2017 |
| WO | WO-2017091753 | A1 | 6/2017 |
| WO | WO-2017102816 | A1 | 6/2017 |
| WO | WO-2017160711 | A1 | 9/2017 |
| WO | WO-2017160944 | A2 | 9/2017 |
| WO | WO-2017182796 | A1 | 10/2017 |
| WO | WO-2017218680 | A1 | 12/2017 |
| WO | WO-2019070913 | A1 | 4/2019 |
| WO | WO-2019089643 | A1 | 5/2019 |
| WO | WO-2019191694 | A1 | 10/2019 |
| WO | W) 2019227085 | A1 * | 11/2019 |

OTHER PUBLICATIONS

Faubion, W. A., et al. "Toxic bile salts induce rodent hepatocyte apoptosis via direct activation of Fas," The Journal of Clinical Investigation 103(1): 137-145, The American Society for Clinical Investigation, United States (Jan. 1999).

Fickert, P., et al. "A new xenobiotic-induced mouse model of sclerosing cholangitis and biliary fibrosis," The American Journal of Pathology 171(2): 525-536, Elsevier on behalf of the American Society for Investigative Pathology, Netherlands (published online Jun. 2007, published in print Aug. 2007).

Hofmann, A. F., "The continuing importance of bile acids in liver and intestinal disease," Archives of Internal Medicine 159(22): 2647-2658, American Medical Association, United States (Dec. 1999).

Hylemon, P. B., et al. "Bile acids as regulatory molecules," Journal of Lipid Research 50(8): 1509-1520, American Society for Biochemistry and Molecular Biology, United States (published online Apr. 2009, published in print Aug. 2009).

Kim, I., et al. "Spontaneous hepatocarcinogenesis in farnesoid X receptor-null mice," Carcinogenesis 28(5): 940-946, Oxford University Press, United Kingdom (published online Dec. 2006, published in print May 2007).

Kohli, R, et al. "Bile Acid Signaling: Mechanism for Bariatric Surgery, Cure for NASH?" Digestive Diseases 33(3): 440-446, S. Karger AG, Switzerland (May 2015).

Parés, A., et al., "Excellent long-term survival in patients with primary biliary cirrhosis and biochemical response to ursodeoxycholic acid," Gastroenterology 130(3): 715-720, W.B. Sasunders Ltd., United Kingdom (Mar. 2006).

Paumgartner, G., and Beuers, U., "Ursodeoxycholic acid in cholestatic liver disease: mechanisms of action and therapeutic use revisited," Hepatology 36(3): 525-531, John Wiley and Sons Ltd., United States (Sep. 2002).

Ridlon, J. M., et al., "Bile salt biotransformations by human intestinal bacteria, " Journal Of Lipid Research 47(2): 241-259, American Society for Biochemistry and Molecular Biology, United States (published online Nov. 2005, published in print Feb. 2006).

Sayin, S. I., et al. "Gut microbiota regulates bile acid metabolism by reducing the levels of tauro-beta-muricholic acid, a naturally occurring FXR antagonist," Cell Metabolism 17(2): 225- 235, Cell Press, United States (Feb. 2013).

(56) References Cited

OTHER PUBLICATIONS

Setchell, K. D., et al. "Hepatic bile acid metabolism during early development revealed from the analysis of human fetal gallbladder bile," Journal of Biological Chemistry 263(32): 16637- 16644, American Society for Biochemistry and Molecular Biology, United States (Nov. 1988).

Sokol, R. J., et al. "Evidence for involvement of oxygen free radicals in bile acid toxicity to isolated rat hepatocytes," Hepatology 17(5): 869-881, John Wiley and Sons Ltd., United States (May 1993).

Tabibian, J. H., et al. "Absence of the intestinal microbiota exacerbates hepatobiliary disease in a murine model of primary sclerosing cholangitis," Hepatology 63(1): 185-196, John Wiley and Sons Ltd., United States (Jan. 2016).

Trottier, J., et al. "Metabolomic profiling of 17 bile acids in serum from patients with primary biliary cirrhosis and primary sclerosing cholangitis: a pilot study," Digestive and Liver Disease 44(4): 303-310, Elsevier, Netherlands (published online Dec. 2011, published in print Apr. 2012).

International Search Report and Written Opinion for Application No. PCT/US2018/046769, European Patent Office, Netherlands, mailed on Nov. 22, 2018, 12 pages.

Seki, Y., et al., "Two neonatal cholestasis patients with mutations in the SRD5B1 (AKRID1) gene: diagnosis and bile acid profiles during chenodeoxycholic acid treatment," Journal Of Inherited Metabolic Disease 36(3):565-573, Springer, Netherlands (published online Nov. 2012, published in print May 2013).

Ziegler, P., "The Elucidation of the Structure of Hyocholic Acid," Canadian Journal of Chemistry 34:523-529, retrieved from the Internet: URL:[http://www.nrcresearchpress.com/doi/pdf/10.1139/v56-073], National Research Council of Canada, Canada (Dec. 1955).

International Search Report and Written Opinion for Application No. PCT/US2018/058279, European Patent Office, Netherlands, mailed on Feb. 18, 2019, 14 pages.

NCT03183128—U.S. National Library of Medicine, "ECOSPOR III—SER-109 Versus Placebo in the Treatment of Adults With Recurrent Clostridium Difficile Infection (ECOSPORIII)," accessed at URL:[https://clinicaltrials.gov/ct2/history/NCT03183128?V_3=View#StudyPageTop] on Sep. 2, 2021, 10 pages.

Seres Therapeutics, "Leading the Microbiome Revolution—Key Findings from SER-109 Phase 2 Study Analyses," accessed at URL:[https://ir.serestherapeutics.com/static-files/5caa8a9c-8428-4608-b57a-7699cea43b74] on Sep. 2, 2021, 24 pages (Jan. 31, 2017).

Lombardo, M-J., et al., "Vancomycin-Resistant Enterococcal iters Diminish Among Patients With Recurrent Clostridium difficile Infection After Administration of SER-109, A Novel Microbiome Agent," Open Forum Infectious Diseases 2(Suppl 1):S149, Abstract #757, accessed at URL:[https://academic.oup.com/ofid/article-pdf/2/suppl_1/757/8247514/ofv133.474.pdf] on Feb. 4, 2019, Oxford University Press, United Kingdom, 2 pages (Dec. 2015).

Khanna, S., et al., "A Novel Microbiome Therapeutic Increases Gut Microbial Diversity and Prevents Recurrent Clostridium difficile Infection," Journal of Infectious Diseases 214(2); 173-181, Oxford University Press, United Kingdom (published online Feb. 2016, published in print Jul. 2016).

Baron, S, A, et al., "Human microbiomes and antibiotic resistance," Human Microbiome Journal 10:43-52, Elsevier, Netherlands (Dec. 2018).

Casals-Pascual, C., et al., "Intestinal microbiota and antibiotic resistance: Perspectives and solutions," Human Microbiome Journal 9:11-15, Elsevier, Netherlands (Aug. 2018).

14th International Congress of Immunology, Kobe, Japan, International Immunology, Aug. 2010, 3 pages, vol. 22, Issue Suppl 1 Pt 3.

Aas, J., et al., "Recurrent Clostridium difficile Colitis: Case Series Involving 18 Patients Treated with Donor Stool Administered via a Nasogastric Tube," Clinical Infectious Diseases 36(5):580-585, Oxford University Press, United States (Mar. 2003).

Abrams, R.S., "Open-label, Uncontrolled Trial of Bowel Sterilization and Repopulation With Normal Bowel Flora for Treatment of Inflammatory Bowel Disease," Current Therapeutic Research 58(12):1001-1012, (Dec. 1997).

Abt, M.C., et al., "Commensal Bacteria Calibrate the Activation Threshold of Innate Antiviral Immunity," Immunity, 37(1):158-170, Cell Press, United States, ( Jul. 2012 ).

Abubucker, S., et al., "Metabolic Reconstruction for Metagenomic Data and Its Application to the Human Microbiome.," Plos Computational Biology, 8(6):1002358, Public Library of Science, United States, (2012).

Accoceberry, I., et al., "One-step Purification of Enterocytozoon Bieneusi Spores From Human Stools by Immunoaffinity Expanded-bed Adsorption," Journal of Clinical Microbiology, 39(5):1947-1951, American Society for Microbiology, United States (May 2001).

Achtman, M., and Wagner, M, "Microbial Diversity and the Genetic Nature of Microbial Species," Nature Reviews. Microbiology, 6(6):431-440, Nature Publication Group, England (Jun. 2008).

Ahern et al., "The interleukin-23 axis m intestinal inflammation," Immunological Reviews 226:147-159 (2008).

Ahmad, T., et al., "Biomarkers of Myocardial Stress and Fibrosis as Predictors of Mode of Death in Patients With Chronic Heart Failure.," Jacc. Heart Failure, 2(3):260-268, Elsevier, United States, (Jun. 2014).

Allen-Vercoe, E., et al., "A Canadian Working Group Report on Fecal Microbial Therapy: Microbial Ecosystems Therapeutics," Canadian Journal of Gastroenterology, 26(7):457-462, Pulsus Group, Canada (Jul. 2012).

Allen-Vercoe, E., Strauss, J., and Chadee, K. (2011). Fusobacterium nucleatum: an emerging gut pathogen? Gut Microbes 2(5), 294-298.

Altschul, S.F., et al., "Basic Local Alignment Search Tool," Journal of Molecular Biology 215(3):403-410, Elsevier, Netherlands (Oct. 1990).

Altschul, S.F., et al., "Gapped BLAST and PSI-BLAST: A New Generation of Protein Database Search Programs," Nucleic Acids Research 25(17):3389-3402, Oxford University Press, England (Sep. 1997).

Anderson, K.F., et al., "Evaluation of Methods to Identify the Klebsiella Pneumoniae Carbapenemase in Enterobacteriaceae," Journal of Clinical Microbiology, 45(8):2723-2725, American Society for Microbiology, United States (Aug. 2007).

Andoh, A., et al., "Terminal Restriction Fragment Polymorphism Analyses of Fecal Microbiota in Five Siblings Including Two with Ulcerative Colitis," Gastroenterology 2(5):343-345, Springer Japan (Oct. 2009).

Anonymous, "Ecobiotic Drugs," Seres Therapeutics, Oct. 22, 2015,http://web.archive.org/web/20151 022091731 /http://web.archive.org/web/2015lecobiotic-drugs, retrieved Mar. 7, 2017 (3 pages).

Anonymous, "Microbiome Therapeutics Platform," Seres Therapeutics, Retrieved on [Oct. 23, 2015], Retrieved from (http:/ /web.archive.org/web/20 151023063153/), Retrieved from (http://www.serestherapeutics.com/ou rscience/ microbiome-therapeutics-platform), Retrieved on [Mar. 7, 2017], 3 pages.

Anonymous, "Product Pipeline," Seres Therapeutics, Oct. 22, 2015], Retrieved from (<http:web.="" arch="" ive.org="" web="" 20="" 151="" 022091722="" http:="" <a=href=>www.serestherapeutics.com/pipeline/products)</http:>, Retrieved on [Mar. 7, 2017], (3 pages).

Application as Filed WO 2011/152566, Filed Jun. 3, 2011, 151 pages.

Arpaia, N., et al., "Metabolites Produced by Commensal Bacteria Promote Peripheral Regulatory T-cell Generation," Nature 504(7480):451-455, Nature Publishing Group, England (Dec. 2013).

Arumugam, M., et al., "Enterotypes of the Human Gut Microbiome," Nature, 473(7346):174-180, Macmillan Journals Limited, England (May 2011).

ASBMT RFI 2016—Disease Classifications Corresponding to CIBMTR Classifications. 2016.

Atarashi, K., et al., "Induction of Colonic Regulatory T Cells by Indigenous *Clostridium* Species," Science 331(6015):337-341, American Association for the Advancement of Science, United States (Jan. 2011) including supplemental data.

(56) References Cited

OTHER PUBLICATIONS

Atarashi, K et al., Supporting Online Material for "Induction of Colonic Regulatory T Cells by Indigenous *Clostridium* Species," Science Express, Dec. 23, 2010, 26 pages.
Atarashi, K., et al., "Treg Induction by a Rationally Selected Mixture of Clostridia Strains From the Human Microbiota," Nature 500(7461):232-236, Nature Publishing Group, England (Aug. 2013) including supplemental data.
Atta, H-M., "Gene therapy for liver regeneration: experimental studies and prospects for clinical trials," World J Gastroenterol 16(32):4019-4030, Baishideng Publishing Group, United States (2010).
Australian First Examination Report, Australian Application No. 2013347805, Apr. 13, 2017, 3 pages.
Australian First Examination Report, Australian Application No. 2014212004, Sep. 21, 2017, 6 pages.
Australian First Examination Report, Australian Application No. 2014232370, Oct. 19, 2017,4 pages.
Autoimmune Disease List, There Are More Than 100 Autoimmune Diseases, American Autoimmune Related Diseases Association, AARDA, Inc., 2014, 4 pages.
Babel, N et al., "Analysis ofT Cell Receptor Repertoire by Newly Established CDR3 High-Throughput Sequencing Allows for Monitoring/Tracing of Antigen-Specific T Cells in Peripheral Blood and Tissue," pp. 063-040, 141h ICI Abstract Book, 141h International Congress of Immunology, 2010, 3 pages.
Bacigalupo, A., et al., "Defining the Intensity of Conditioning Regimens: Working Definitions.," Biology of Blood and Marrow Transplantation : Journal of the American Society for Blood and Marrow Transplantation, 15(12):1628-1633, Carden Jennings Publishing, United States, (Dec. 2009).
Backhed, F., et al., "The Gut Microbiota as an Environmental Factor That Regulates Fat Storage," Proceedings of the National Academy of Sciences of the United States of America, 101(44):15718-15723, National Academy of Sciences, United States (Nov. 2004).
Bader, J., Albin, A., and Stahl, U. (2012). Spore-forming bacteria and their utilisation as probiotics. Benef Microbes 3(1), 67-75.
Bajaj, J.S., et al., "Colonic Mucosal Microbiome Differs From Stool Microbiome in Cirrhosis and Hepatic Encephalopathy and is Linked to Cognition and Inflammation.," American Journal of Physiology. Gastrointestinal and Liver Physiology, 303(6):75-85, American Physiological Society, United States, (Sep. 2012).
Bakken, J.S., et al., "Treating Clostridium Difficile Infection With Fecal Microbiota Transplantation," Clinical Gastroenterology and Hepatology 9(12):1044-1049, Saunders for the American Gastroenterological Association, United States (Dec. 2011).
Bakken, J.S., "Fecal Bacteriotherapy for Recurrent Clostridium Difficile Infection," Anaerobe 15(6):285-289, Academic Press, England (Dec. 2009).
Barrasa, J.I., et al., "Bile Acids in the Colon, From Healthy to Cytotoxic Molecules.," Toxicology in Vitro : an International Journal Published in Association With Bibra, 27(2):964-977, Pergamon Press , England, (Mar. 2013).
Barreau, M., et al., "Improving the Identification of Anaerobes in the Clinical Microbiology Laboratory Through MALDI-TOF Mass Spectrometry," Anaerobe, 22:123-125, Academic Press, England (Aug. 2013).
Barrell, C., et al., "Reduced-intensity Conditioning Allogeneic Stem Cell Transplantation in Pediatric Patients and Subsequent Supportive Care.," Oncology Nursing Forum, 39(6):451-458, Oncology Nursing Society, United States, (Nov. 2012).
Bartlett, J.G., et al., "Antibiotic-associated Pseudomembranous Colitis Due to Toxin-Producing Clostridia, " The New England journal of medicine, 298(10):531-534, Massachusetts Medical Society, United States , (Mar. 1978 ).
Basler, M., et al., "Tit-for-tat: Type Vi Secretion System Counterattack During Bacterial Cell-cell Interactions," Cell, 152(4):884-894, Cell Press, United States, (Feb. 2013 ).
Basler, M., et al., "Type Vi Secretion Requires a Dynamic Contractile Phage Tail-like Structure," Nature, 483(7388):182-186, Nature Publishing Group, England, (Feb. 2012 ).
Bauer, T.M., et al., "Derivation and Validation of Guidelines for Stool Cultures for Enteropathogenic Bacteria Other Than Clostridium Difficile in Hospitalized Adults," JAMA, 285(3:313-319, American Medical Association, United States (Jan. 2001).
Beelen et al., "Influence of Intestinal Bacterial Decontamination Using Metronidazole and Ciprofloxacin or Ciprofloxacin Alone on the Development of Acute Graft-Versus-Host Disease After Marrow Transplantation in Patients with Hematologic Malignancies: Final Results and Long-Term Follow-Up of an Open-Label Prospective Randomized Trial," Blood 93(10):3267-3275 (1999).
Begley et al., "Bile Salt Hydrolase Activity in Probiotics," Appl. Environ Microbial. 72(3): I729-173 8 (2006).
Belkaid, Y, and Rouse, B,T., "Natural Regulatory T Cells in Infectious Disease," Nature Immunology 6(4):353-360, Nature America Inc, United States (Apr. 2005).
Ben-Amor, K., et al., "Genetic Diversity of Viable, Injured, and Dead Fecal Bacteria Assessed by Fluorescence-activated Cell Sorting and 16S rRNA Gene Analysis," Applied and Environmental Microbiology, 71(8):4679-4689, American Society for Microbiology, United States (Aug. 2005).
Bernstein, H., et al., "Bile Acids as Carcinogens in Human Gastrointestinal Cancers.," Mutation research, 589(1):47-65, Elsevier, Netherlands, (Jan. 2005).
Berst Ad, A., et al., "Fecal Fat Determination With a Modified Titration Method," Scandinavian Journal of Gastroenterology, 45(5):603-607, Informa Healthcare, England (May 2010).
Bhatia, A et al., "Proionibacterium Acnes and Chronic Diseases," The Infectious Etiology of Chronic Diseases: Defining the Relationship, Enhancing the Research, and Mitigating the Effects: Workshop Summary., Knobler, S.L. et al. (eds.), 2004, pp. 74-80, may be downloaded at (URL:http://www.nap.edu/catalog/11026.html).
Bidawid, S., et al., "Heat Inactivation of Hepatitis a Virus in Dairy Foods," Journal of Food Protection, 63(4):522-528, International Association for Food Protection, United States (Apr. 2000).
Bloedt, K., et al., "Evaluation of New Selective Culture Media and a Rapid Fluorescence in Situ Hybridization Assay for Identification of Clostridium Difficile From Stool Samples," Journal of Medical Microbiology, 58(7):874-877, Microbiology Society, England (Jul. 2009).
Bokulich, N.A., et al., "Quality-filtering Vastly Improves Diversity Estimates From Illumina Amplicon Sequencing," Nature Methods, 10(1):57-59, Nature Publications Group, United States (Jan. 2013).
Bolger, A.M.,et al., "Trimmomatic: a Flexible Trimmer for Illumina Sequence Data.," Bioinformatics (Oxford, England), 30(15):2114-2120, Oxford University Press,England, (Aug. 2014).
Bolivar, I., et al., "Bacterial Diversity in Oral Samples of Children in Niger With Acute Noma, Acute Necrotizing Gingivitis, and Healthy Controls," Plos Neglected Tropical Diseases, 6(3):e1556, Public Library of Science, United States (2012).
Borody, T.J., and Khoruts, A, "Fecal Microbiota Transplantation and Emerging Applications," Nature Reviews. Gastroenterology & Hepatology, 9(2):88-96, Nature Publication Group, England (Feb. 2012).
Borody, T.J. et al. (2011). Fecal microbiota transplantation (FMT) in multiple sclerosis. Poster abstract at American College of Gastroenterology Annual Scientific Meeting and Postgraduate Course Oct. 28, 2011.
Borody, T,J., et al., "Treatment of Ulcerative Colitis Using Fecal Bacteriotherapy," Journal of Clinical Gastroenterology 37(1):42-47, Wolters Kluwer Health, Inc, United States (Jul. 2003).
Borriello, S.P., and Barclay, F.E, "An In-Vitro Model of Colonisation Resistance to Clostridium Difficile Infection," Journal of Medical Microbiology, 21(4):299-309, Microbiology Society, England (Jun. 1986).
Borriello, S.P., and Barclay, F.E, "Protection of Hamsters Against Clostridium Difficile Ileocaecitis by Prior Colonisation With Non-pathogenic Strains," Journal of Medical Microbiology, 19(3):339-350, Microbiology Society,England (Jun. 1985).

(56) References Cited

OTHER PUBLICATIONS

Borriello, S.P., and Honour, P, "Simplified Procedure for the Routine Isolation of Clostridium Difficile From Faeces," Journal of Clinical Pathology, 34(10):1124-1127, BMJ Publication Group, England (Oct. 1981).
Borriello, S.P., "The Influence of the Normal Flora on Clostridium Difficile Colonisation of the Gut," Annals of Medicine, , 22(1):61-67, Informa Healthcare, England (Feb. 1990).
Boyles, W.A., and Lincoln, R.E, "Separation and Concentration of Bacterial Spores and Vegetative Cells by Foam Flotation," Applied Microbiology, 6(5):327-334, American Society for Microbiology, United States (Sep. 1958).
Brandl et al., "Vancomycin-resistant enterococci exploit anti biotic-induced innate immune deficit,". Nature 455(7214):804-807 (2008).
Brandt, L.J., et al., "Long-term Follow-up of Colonoscopic Fecal Microbiota Transplant for Recurrent Clostridium Difficile Infection," The American Journal of Gastroenterology, 107(7):1079-1087, Wolters Kluwer Health, United States (Jul. 2012).
Brandt, L.J., "Fecal Transplantation for the Treatment of Clostridium Difficile Infection," Gastroenterology & Hepatology, 8(3):191-194, Gastro-Hep Communications, United States (Mar. 2012).
Brauniger, S., et al., "Further Studies on Thermal Resistance of Bovine Parvovirus Against Moist and Dry Heat," International Journal of Hygiene and Environmental Health, 203(1):71-75, Urban & Fischer, Germany (Mar. 2000).
Britton, R.A., et al., "Role of the Intestinal Microbiota in Resistance to Colonization by Clostridium Difficile," Gastroenterology 146(6):1547-1553, W.B. Saunders, United States (May 2014).
Broda, D.M., et al., "Efficacy of Heat and Ethanol Spore Treatments for the Isolation of Psychrotrophic *Clostridium* Spp. Associated With the Spoilage of Chilled Vacuum-packed Meats," International Journal of Food Microbiology, 39(1-2):61-68, Elsevier Science Publishers, Netherlands (Jan. 1998).
Brosius, J., et al., "Complete Nucleotide Sequence of a 16S Ribosomal RNA Gene From *Escherichia coli*," Proceedings of the National Academy of Sciences of the United States of America 75(10):4801-4805, National Academy of Sciences, United States (Oct. 1978).
Browne, H,P., et al., "Culturing of 'unculturable' Human Microbiota Reveals Novel Taxa and Extensive Sporulation," Nature 533(7604):543-546, Nature Publishing Group, England (May 2016).
Bueche, M., et al., "Quantification of Endospore-forming Firmicutes by Quantitative PCR With the Functional Gene Spo0A," Applied and Environmental Microbiology 79(17):5302-5312, American Society for Microbiology, United States (Sep. 2013).
Buffie, C. G., et al., "Precision Microbiome Reconstitution Restores Bile Acid Mediated Resistance to Clostridium Difficile," Nature 517(7533):205-208, Nature Publishing Group, England (Jan. 2015).
Buffie, C.G. and Pamer, E.G., "Microbiota-mediated Colonization Resistance Against Intestinal Pathogens," Nature Reviews. Immunology 13(11):790-801, Nature Pub. Group, England (Nov. 2013).
Buffie, C.G., et al., "Profound Alterations of Intestinal Microbiota Following a Single Dose of Clindamycin Results in Sustained Susceptibility to Clostridium Difficile-induced Colitis," Infection and Immunity, 80(1):62-73, American Society For Microbiology, United States, (Jan. 2012 ).
Burke, C.J., et al., "Formulation, Stability, and Delivery of Live Attenuated Vaccines for Human Use," Critical Reviews in Therapeutic Drug Carrier Systems, 16(1):1-83, Begell House, United States (1999).
Caballero, S and Pamer, E.G., "Microbiota-Mediated Inflammation and Antimicrobial Defense in the Intestine," Annual Review of Immunology 33:227-256, Annual Reviews Inc., United States (2015).
Caballero, S. et al. "Distinct but Spatially Overlapping Intestinal Niches for Vancomycin-Resistant Enterococcus faecium and Carbapenem-Resistant Klebsiella Pneumoniae" PLOS Pathogens 11(9):e1005132, Public Library of Science, United States (2015).
Cani, P.D., et al., "Changes in Gut Microbiota Control Inflammation in Obese Mice Through a Mechanism Involving Glp-2-driven Improvement of Gut Permeability," Gut, 58(8):1091-1103, British Medical Association, England (Aug. 2009).
Caporaso, J.G., et al., "QIIME Allows Analysis of High-throughput Community Sequencing Data," Nature Methods, 7(5):335-336, Nature Publishing Group, United States, (May 2010 ).
Caporaso, J.G., et al., "Ultra-High-Throughput Microbial Community Analysis on the Illumina Hiseq and Miseq Platforms," The Isme Journal, 6(8):1621-1624, Nature Publishing Group, England, (Aug. 2012).
Carlier, J.P., et al., "Proposal to Unify Clostridium Orbiscindens Winter et al. 1991 and Eubacterium Plautii (Séguin 1928) Hofstad and Aasjord 1982, With Description of Flavonifractor Plautii Gen. Nov., Comb. Nov., and Reassignment of Bacteroides Capillosus to Pseudoflavonifractor Capillosus Gen. Nov., Comb. Nov.," International Journal of Systematic and Evolutionary Microbiology 60(Pt 3):585-590, Microbiology Society, England (Mar. 2010).
Carvalho, A. S., et al., "Effects of Various Sugars Added to Growth and Drying Media Upon Thermotolerance and Survival Throughout Storage of Freeze-dried Lactobacillus Delbrueckii SSP Bulgaricus," Biotechnology Progress, 20(1):248-254, Wiley-Blackwell, United States (Jan. 2004).
Casula, G. and Cutting, S.M., "Bacillus Probiotics: Spore Germination in the Gastrointestinal Tract," Applied and Environmental Microbiology 68(5):2344-2352, American Society for Microbiology, United States (May 2002).
Cato, E.P., et al., "Clostridium Oroticum Comb. Nov. Amended Description," International Journal of Systematic and Evolutionary Microbiology 17(1):9-13, (Jan. 1968).
Certified translation of second priority document, PCT/JP2010/071746, 79 pages, Dec. 27, 2017.
Champagne, C.P., et al., "Effect of Polymers and Storage Temperature on the Stability of Freeze-dried Lactic Acid Bacteria," Food Research International, 29(5-6):555-562 (Jun.-Aug. 1996).
Chang, J.Y., et al., "Decreased Diversity of the Fecal Microbiome in Recurrent Clostridium Difficile-Associated Diarrhea," The Journal of Infectious Diseases 197(3):435-438, Oxford University Press, United States (Feb. 2008).
Chapman, C.M.C., et al., "In Vitro Evaluation of Single- and Multi-strain Probiotics: Inter-species Inhibition Between Probiotic Strains, and Inhibition of Pathogens," Anaerobe, 18(4):405-413, Academic Press, England (Aug. 2012).
Chen, W., et al., "Human Intestinal Lumen and Mucosa-associated Microbiota in Patients With Colorectal Cancer.," Plos One, 7(6):39743, Public Library of Science, United States, (2012).
Chen, X., et al., "A Mouse Model of Clostridium Difficile-associated Disease," Gastroenterology, 135(6):1984-1992, W.B. Saunders, United States (Dec. 2008).
Chen, X., et al., "Overview of Clostridium Difficile Infection: Implications for China," Gastroenterology Report, 1(3):153-158, Oxford University Press and Science Digestive, England, (Nov. 2013).
Chiang, J.Y.L., "Bile Acid Metabolism and Signaling," Comprehensive Physiology 3(3):1191-1212, John Wiley and Sons, United States (Jul. 2013).
Chinese First Office Action, Chinese Application No. 201380071190X, Jul. 4, 2018, 11 pages (with a concise explanation of relevance).
Chinese First Office Action, Chinese Application No. 201480019395.8, dated Jul. 17, 2017, 29 pages.
Chinese Second Office Action, Chinese Application No. 201480019395.8, Apr. 4, 2018 (with concise explanation of relevance), 14 pages.
Chiu, C-H. and Ou, J-T, "Rapid Identification of *Salmonella* Serovars in Feces by Specific Detection of Virulence Genes, Inva and Spvc, by an Enrichment Broth Culture-multiplex Pcr Combination Assay," Journal of Clinical Microbiology, 34(10):2619-2622, American Society for Microbiology, United States (Oct. 1996).
Chow, J., Tang, H., and Mazmanian, S.K, "Pathobionts of the Gastrointestinal Microbiota and Inflammatory Disease," Current opinion in immunology, 23(4):473-480, Elsevier, England (Aug. 2011).
Chromek, M.,et al., "The Antimicrobial Peptide Cathelicidin Protects Mice From *Escherichia coli* O157:h7-mediated Disease.," Plos One, 7(10):46476, Public Library of Science, United States, (2012).

(56) References Cited

OTHER PUBLICATIONS

Chung, H., et al., "Gut Immune Maturation Depends on Colonization With a Host-specific Microbiota," Cell 149(7):1578-1593, Cell Press, United States (Jun. 2012).
Claesson, M.J., et al., "Comparison of Two Next-generation Sequencing Technologies for Resolving Highly Complex Microbiota Composition Using Tandem Variable 16S rRNA Gene Regions," Nucleic Acids Research 38(22):e200, Oxford University Press, England (Dec. 2010).
Clemente, J.C., et al., "The Impact of the Gut Microbiota on Human Health: an Integrative View," Cell, 148(6):1258-1270, Cell Press, United States (Mar. 2012).
Clifford, R.J., et al., "Detection of Bacterial 16s Rrna and Identification of Four Clinically Important Bacteria by Real-time Pcr.," Plos One, 7(11):48558, Public Library of Science, United States, (2012).
Cline, M.J., "Perspectives for Gene Therapy: Inserting New Genetic Information Into Mammalian Cells by Physical Techniques and Viral Vectors," Pharmacology & Therapeutics 29(1):69-92, Pergamon Press, England (1985).
Cohen, Statistical Power Analysis for the Behavioral Sciences, Second Edition (Routledge, Hillsdale, NJ, 1988).
Coleman, W.H., "Mechanism of Killing of Spores of Bacillus Cereus and Bacillus Megaterium by Wet Heat," Letters in Applied Microbiology, 50(5):507-514, Blackwell Scientific Publications, England (May 2010).
Collins, M,D., et al., "The Phylogeny of the Genus Clostridium: Proposal of Five New Genera and Eleven New Species Combinations," International Journal of Systematic Bacteriology 44(4):812-826, Society for General Microbiology, England (Oct. 1994).
Cooke et al., "LPS antagonism reduces graft-versus-host disease and preserves graftversus-leukemia activity after experimental bone marrow transplantation," J. Clin. Invest. 107:1581-1589 (2001).
Cooke, K.R., et al., "An Experimental Model of Idiopathic Pneumonia Syndrome After Bone Marrow Transplantation: I. The Roles of Minor H Antigens and Endotoxin.," Blood, 88(8):3230-3239, American Society of Hematology, United States, (Oct. 1996).
Copelan, E., et al., "A Scheme for Defining Cause of Death and Its Application in the T Cell Depletion Trial.," Biology of Blood and Marrow Transplantation : Journal of the American Society for Blood and Marrow Transplantation, 13(12):1469-1476, Carden Jennings Publishing, United States, (Dec. 2017).
Cotten, M., et al., "Receptor-mediated Transport of DNA Into Eukaryotic Cells," Methods in Enzymology 217:618-644, Academic Press, United States (1993).
Cover Page of Science, Jan. 21, 2011, 1 page.
Cruz, M. C., et al., "Immunosuppressive and Nonimmunosuppressive Cyclosporine AnalogsAre Toxic to the Opportunistic Fungal Pathogen Cryptococcus neoformans via Cyclophilin-Dependent Inhibition of Calcineurin," Antimicrob. Agents Chemother. 44(1):143-149, American Society for Microbiology (2000).
Cunliffe, R.N. and Scott, B.B., "Review Article: Monitoring for Drug Side-effects in Inflammatory Bowel Disease," Alimentary Pharmacology & Therapeutics 16(4):647-662, Wiley-Blackwell, England (Apr. 2002).
Current Uses and Outcomes of Hematopoietic Stem Cell Transplantation 2012 CIBMTR Summary Slides, 2012.
Dabard J., et al., "Ruminococcin A, a New lantibiotic Produced by a Ruminococcus Gnavus Strain Isolated from Human Feces," Applied and Environmental Microbiology, 67(9):4111-4118, American Society for Microbiology, United States (Sep. 2001).
Das et al., "Blockade ofinterleukin-23 signaling results in targeted protection ofthe colon and allows for separation of graft-versus-host and graft-versus-leukemia responses," Blood 115(25):5249-5258 (2010).
Das, R., et al., "Interleukin-23 Secretion by Donor Antigen-presenting Cells is Critical for Organ-specific Pathology in Graft-versus-host Disease.," Blood, 113(10):2352-2362, American Society of Hematology, United States, (Mar. 2009).
David, L.A., Maurice, C.F., Carmody, R.N., Gootenberg, D.B., Button, J.E., Wolfe, B.E., Ling, A.V., Devlin, A.S., Varma, Y., Fischbach, M.A., et al. (2013). Diet rapidly and reproducibly alters the human gut microbiome. Nature advance online publication.
De Aguiar Vallim, T.Q., et al., "Pleiotropic Roles of Bile Acids in Metabolism," Cell Metabolism, 17(5):657-669, Cell Press, United States, (May 2013).
Deangelis, M., et al., "Fecal Microbiota and Metabolome of Children With Autism and Pervasive Developmental Disorder Not Otherwise Specified," PloS One, 8(10):e76993, Public Library of Science, United States (Oct. 2013).
Defined Fecal Microbiota Transplantation for Clostridium Difficile Diarrhea. (http://clinicaltrials.gov/ct2/show/NCT01868373); Accessed Mar. 26, 2014.
Delay, M.L.,et al., "Hla-b27 Misfolding and the Unfolded Protein Response Augment Interleukin-23 Production and Are Associated With Th17 Activation in Transgenic Rats. ," Arthritis and Rheumatism, 60(9):2633-2643, Hoboken, N.J. : Wiley-Blackwell, United States, (Sep. 2009).
Dendukuri, N., "Probiotic Therapy for the Prevention and Treatment of Clostridium Difficile-associated Diarrhea: A Systematic Review," Canadian Medical Association Journal, 173(2):167-170, Canadian Medical Association, Canada (Jul. 2005).
Derrien, M., "*Akkermansia muciniphila* Gen. Nov., Sp. Nov., a Human Intestinal Mucin-degrading Bacterium," International Journal of Systematic and Evolutionary Microbiology, 54(5):1469-1476, Microbiology Society, England (Sep. 2004).
Derrien, M., et al., "Modulation of Mucosal Immune Response, Tolerance, and Proliferation in Mice Colonized by the Mucin-degrader Akkermansia Muciniphila.," Frontiers in Microbiology, 2:166, Frontiers Research Foundation, Switzerland., (Aug. 2011).
Derrien, M., et al., "Mucin-bacterial Interactions in the Human Oral Cavity and Digestive Tract.," Gut Microbes, 1(4):254-268, PA : Taylor & Francis, United States, (Jul. 2010).
Desantis, T.Z., et al., "Greengenes, a Chimera-Checked 16S RRNA Gene Database and Workbench Compatible With ARB.," Applied and Environmental Microbiology, 72(7):5069-5072, American Society for Microbiology, United States, (Jul. 2006).
Dethlefsen, L., et al., "Incomplete Recovery and Individualized Responses of the Human Distal Gut Microbiota to Repeated Antibiotic Perturbation," Proceedings of the National Academy of Sciences of the United States of America, 108 Suppl 1:4554-4561, National Academy of Sciences, United States, (Mar. 2011).
Dethlefsen, L., "The Pervasive Effects of an Antibiotic on the Human Gut Microbiota, as Revealed by Deep 16S rRNA Sequencing," PLoS Biology, 6(11):e280, Public Library of Science, United States (Nov. 2008).
Detmer, A., and Glenting, J., "Live Bacterial Vaccines—A Review and Identification of Potential Hazards," Microbial Cell Factories, 5:23, BioMed Central, England (Jun. 2006).
Devos, W.M., "Fame and Future of Faecal Transplantations—developing Next-generation Therapies With Synthetic Microbiomes," Microbial Biotechnology, 6(4):316-325, Wiley-Blackwell, United States (Jul. 2013).
Dewhirst, F.E., et al., "Phylogeny of the Defined Murine Microbiota: Altered Schaedler Flora," Applied and Environmental Microbiology 65(8):3287-3292, American Society for Microbiology, United States (Aug. 1999).
Dezfulian, M., et al., "Selective Medium for Isolation of Clostridium Botulinum From Human Feces," Journal of Clinical Microbiology, 13(3):526-531, American Society for Microbiology, United States (Mar. 1981).
Dharmani, P., et al., "The Probiotic Mixture VSL#3 Accelerates Gastric Ulcer Healing by Stimulating Vascular Endothelial Growth Factor," PloS One , 8(3):e58671, Public Library of Science, United States (Mar. 2013).
Diehl, G.E., et al., "Microbiota Restricts Trafficking of Bacteria to Mesenteric Lymph Nodes by Cx(3)crl(Hi) Cells," Nature, 494(7435):116-120, Nature Publishing Group, England, (Feb. 2013).
Dietrich, G., Collioud, A., and Rothen, S.A. (2008). Developing and Manufacturing Attenuated Live Bacterial Vaccines. (http://www.biopharminternational.com/biopharm/Vaccine+Manufacturing+

(56) References Cited

OTHER PUBLICATIONS

Articles/Developing-and-Manufacturing-Attenuated-Live-Bacte/ArticleStandard/Article/detail/557306) Accessed Mar. 25, 2014.
D'Souza, D.H., and Su, X, "Efficacy of Chemical Treatments Against Murine Norovirus, Feline Calicivirus, and MS2 Bacteriophage," Foodborne Pathogens and Disease, 7(3):319-326, Mary Ann Liebert, incorporated, United States (Mar. 2010).
Dowell, V.R., et al., "Coproexamination for Botulinal Toxin and Clostridium Botulinum. A New Procedure for Laboratory Diagnosis of Botulism," JAMA, 238(17): 1829-1832, American Medical Association, United States (Oct. 1977).
Dragon, D.C., and Rennie, R.P, "Evaluation of Spore Extraction and Purification Methods for Selective Recovery of Viable Bacillus Anthracis Spores," Letters in Applied Microbiology, 33(2):100-105, Blackwell Scientific Publications, England (Aug. 2001).
Duan, J., et al., "Microbial Colonization Drives Expansion of Il-1 Receptor 1-expressing and Il-17-producing Gamma/delta T Cells," Cell host & microbe, 7(2):140-150, Cell Press, United States, (Feb. 2010).
Duc, L., et al., "Germination of the Spore in the Gastrointestinal Tract Provides a Novel Route for Heterologous Antigen Delivery," Vaccine, 21(27-30):4215-4224, Elsevier Science, Netherlands (Oct. 2003).
Duc, L.H., et al., "Characterization of Bacillus Probiotics Available for Human Use," Applied and Environmental Microbiology 70(4):2161-2171, American Society for Microbiology, United States (Apr. 2004).
Duc, L.H., et al., "Bacterial Spores as Vaccine Vehicles," Infection and Immunity, 71(5):2810-2818, American Society for Microbiology, United States (May 2003).
Dumas, M.E., et al., "Metabolic Profiling Reveals a Contribution of Gut Microbiota to Fatty Liver Phenotype in Insulin-resistant Mice," Proceedings of the National Academy of Sciences of the United States of America, 103(33):12511-12516, National Academy of Sciences, United States (Aug. 2006).
Duncker, S.C.,et al., "The D-alanine Content of Lipoteichoic Acid is Crucial for Lactobacillus Plantarum-mediated Protection From Visceral Pain Perception in a Rat Colorectal Distension Model.," Neurogastroenterology and Motility : the Official Journal of the European Gastrointestinal Motility Society, 20(7):843-850, Blackwell Scientific Publications, c1994, England, (Jul. 2008).
Dutta, S.K., et al., "Efficacy of Combined Jejunal and Colonic Fecal Microbiota Transplantation for Recurrent Clostridium Difficile Infection," Clinical Gastroenterology and Hepatology, 12(9):1572-1576, W.B. Saunders for the American Gastroenterological Association, United States (Sep. 2014).
Edgar, R.C., et al., "Uchime Improves Sensitivity and Speed of Chimera Detection," Bioinformatics, 27(16):2194-2200, Oxford University Press, England, (Aug. 2011).
Edwards, A.D., and Slater, N.K.H, "Formulation of a Live Bacterial Vaccine for Stable Room Temperature Storage Results in Loss of Acid, Bile and Bile Salt Resistance," Vaccine, 26(45):5675-5678, Elsevier Science, Netherlands (Oct. 2008).
Eeckhaut, V., et al., "The Anaerobic Butyrate-producing Strain Butyricicoccus Pullicaecorum Decreases Colonic Inflammation and Ulceration in a Tnbs-induced Colitis Rat Model," 5th Probiotics, Prebiotics and New Foods Congress, 2009,1 page.
Eiseman, B., et al., "Fecal Enema as an Adjunct in the Treatment of Pseudomembranous Enterocolitis," Surgery, 44(5):854-859, St. Louis, MO : Mosby, United States (Nov. 1958).
Elhage, R. et al., "Emerging Trends in "Smart Probiotics": Functional Consideration for the Development of Novel Health and Industrial Applications," Frontiers in Microbiology, Sep. 2017, pp. 1-11, vol. 8, Article 1889.
El-Houssieny, R., et al., "Recovery and Detection of Microbial Contaminants in Some Non- Sterile Pharmaceutical Products," Archives of Clinical Microbiology, 4(6):1-14, Ain Shams University, Egypt (2013).
Elving, J., et al., "Composting for Avian Influenza Virus Elimination," Applied and Environmental Microbiology, 78(9):3280-3285, American Society for Microbiology, United States (May 2012).
Emanuelsson, F., et al., "Faecal Microbiota Transplantation and Bacteriotherapy for Recurrent Clostridium Difficile Infection: A Retrospective Evaluation of 31 Patients," Scandinavian Journal of Infectious Diseases, 46(2):89-97, Informa Healthcare, England (Feb. 2014).
Endt, K., et al., "The Microbiota Mediates Pathogen Clearance From the Gut Lumen After Non- Typhoidal Salmonella Diarrhea, " PLoS Pathogens, 6(9):e1001097, Public Library of Science, United States (Sep. 2010).
Eriguchi et al., "Graft versus-host disease disrupts intestinal microbial ecology by inhibiting Paneth cell production of a-defensins," Blood 120(1):223-231 (2012).
European Examination Report for EP Application No. EP 11728077.6, mailed on Sep. 18, 2015, 4 pages.
European Examination Report for EP Application No. EP 13856249.1, mailed on May 23, 2018, 6 pages.
European Examination Report for EP Application No. EP 14745749.3, mailed on Oct. 31, 2017, 3 pages.
European Examination Report for EP Application No. EP 14745792.3, mailed on Dec. 21, 2017, 6 pages.
European Examination Report for EP Application No. EP 14746341.8 , mailed on Jun. 13, 2017, 11 pages.
European Examination Report for EP Application No. EP 14746341.8, mailed on Apr. 18, 2018, 7 pages.
European Examination Report for EP Application No. EP 14746455.6, mailed on Oct. 31, 2017, 6 pages.
European Examination Report for EP Application No. EP 14763266.5, mailed on Nov. 13, 2017, 4 pages.
European Examination Report for EP Application No. EP 14768281.9 mailed on Dec. 18, 2017, 4 pages.
European Examination Report for EP Application No. EP 14821918.1, mailed on Jan. 29, 2018, 4 pages.
European Extended Search Report, EP Application No. EP 14746455.6, mailed on Nov. 24, 2016, 9 pages.
European Extended Search Report for EP Application No. EP 13856249.1, mailed on Jan. 26, 2017, 22 pages.
European Extended Search Report for EP Application No. EP 14745749.3, mailed on Jan. 23, 2017, 13 pages.
European Extended Search Report for EP Application No. EP 14745792.3, mailed on Dec. 23, 2016, 17 pages.
European Extended Search Report for EP Application No. EP 14746341.8, mailed on Sep. 28, 2016, 9 pages.
European Extended Search Report for EP Application No. EP 14763266.5, mailed on Aug. 16, 2016, 7 pages.
European Extended Search Report for EP Application No. EP 14768281.9, mailed on Jul. 18, 2016, 9 pages.
European Extended Search Report for EP Application No. EP 14870947.0, mailed on Oct. 17, 2017, 11 pages.
European Partial Supplementary Report for EP Application No. EP 14745749.3, mailed on Oct. 14, 2016, 6 pages.
European Partial Supplementary Report for EP Application No. EP 14745792.3, mailed on Sep. 20, 2016, 10 pages.
European Partial Supplementary Search Report for EP Application No. EP 14870947.0, mailed on Jul. 11, 2017,13 pages.
European Summons to Attend Oral Proceedings Pursuant to Rule 115(1) EPC for EP Application No. EP 14768281.9, mailed on Jul. 11, 2018, 10 pages.
Everard, A., et al., "Cross-talk Between Akkermansia Muciniphila and Intestinal Epithelium Controls Diet-Induced Obesity," Proceedings of the National Academy of Sciences of the United States of America, 110(22):9066-9071, National Academy of Sciences, United States (May 2013).
Evidence of Effects of Probiotics Against Antimicrobial-Related Diarrhea, Pharmacy, Paper, 12 pages, (2011).
Ezaki, T., et al., "16s Ribosomal Dna Sequences of Anaerobic Cocci and Proposal of Ruminococcus Hansenii Comb. Nov. and Ruminococcus Productus Comb. Nov," International Journal of Systematic Bacteriology 44(1):130-136, Society for General Microbiology, England (Jan. 1994).

(56) References Cited

OTHER PUBLICATIONS

Fairhead, H., et al., "Small, Acid-soluble Proteins Bound to DNA Protect Bacillus Subtilis Spores From Being Killed by Freeze-Drying.," Applied and Environmental Microbiology, 60(7):2647-2649, American Society for Microbiology, United States (Jul. 1994).
Faith, J.J., et al., "Identifying Gut Microbe-host Phenotype Relationships Using Combinatorial Communities in Gnotobiotic Mice," Science Translational Medicine, 6(220):220ra11, American Association for the Advancement of Science, United States (Jan. 2014).
Fakhry, S., et al., "Characterization of Spore Forming Bacilli Isolated From the Human Gastrointestinal Tract," Journal of Applied Microbiology, 105(6):2178-2186, Blackwell Science, England (Dec. 2008).
Farache, J., et al., "Luminal Bacteria Recruit Cd103+ Dendritic Cells Into the Intestinal Epithelium to Sample Bacterial Antigens for Presentation," Immunity, 38(3):581-595, Cell Press, United States, (Mar. 2013).
Faust, et al., "Microbial Co-occurrence Relationships in the Human Microbiome," Plos Computational Biology, 8(7):e1002606, Public Library of Science, United States (Jul. 2012).
Fell Jr., N.F., et al., "Mitigating Phosphate Interference in Bacterial Endospore Detection by Tb Dipicolinate Photoluminescence," Analytica Chimica Acta, 426(11):43-50, Elsevier (Jan. 2001).
Ferreira, R.B., et al., "The Intestinal Microbiota Plays a Role in Salmonella-induced Colitis Independent of Pathogen Colonization," Plos One, 6(5):e20338, Public Library of Science, United States, (May 2011).
Fichtel, J., et al., "Spore Dipicolinic Acid Contents Used for Estimating the Number of Endospores in Sediments," FEMS Microbiology Ecology, 61(3):522-532, Elsevier Science Publishers on behalf of the Federation of European Microbiological Societies, England (Sep. 2007).
Fickert, P., et al., "Regurgitation of Bile Acids from Leaky Bile Ducts Causes Sclerosing Cholangitis In Mdr2 (Abcb4) Knockout Mice," Gastroenterology 127(1):261-274, W.B. Saunders, United States (Jul. 2004).
Final Office Action mailed Nov. 1, 2019, in U.S. Appl. No. 16/054,864, Gregory Mckenzie et al., filed Aug. 3, 2018, 10 pages.
Final Office Action mailed Dec. 7, 2017, in U.S. Appl. No. 14/765,812, Afeyan, N.B., et al., filed Aug. 4, 2015.
Final Office Action mailed Jan. 8, 2018, in U.S. Appl. No. 14/765,810, Maltzahn, G.V., et al., filed Aug. 4, 2015.
Final Office Action mailed May 11, 2017, in U.S. Appl. No. 14/777,252 , Henn, M.R., et al., filed Sep. 15, 2015.
Final Office Action mailed Jan. 25, 2018, in U.S. Appl. No. 14/765,810, Maltzahn, G.V., et al., filed Aug. 4, 2015.
Final Office Action mailed Apr. 14, 2020, in U.S. Appl. No. 16/223,008, Henn, M.R et al., filed Dec. 17, 2018, 11 pages.
Final Office action mailed Dec. 11, 2019, in U.S. Appl. No. 14/765,812, Afey An; N. et al., filed Aug. 4, 2015, 10 pages.
Final Office action mailed Jan. 18, 2019, in U.S. Appl. No. 14/765,814, Cook; D. et al., filed Aug. 4, 2015, 14 pages.
Final Office Action mailed Jul. 29, 2020, in U.S. Appl. No. 15/778,095, Button, J. et al., filed May 22, 2018, 40 pages.
Final Office Action mailed Jun. 12, 2018, in U.S. Appl. No. 15/039,007, 9 pages.
Final Office Action mailed Jun. 22, 2018, in U.S. Appl. No. 14/776,676, , 15 pages.
Final Office Action mailed May 5, 2020, in U.S. Appl. No. 14/765,814, Cook, D et al., filed Aug. 4, 2015, 16 pages.
Fischbach, M.A., et al., "Cell-based Therapeutics: The Next Pillar of Medicine," Science Translational Medicine, 5(179):179ps7, American Association for the Advancement of Science, United States (Apr. 2013).
Fitzpatrick, L.R., "Probiotics for the treatment of Clostridium difficile associated disease" World Journal of Gastrointestinal Pathophysiology, 4(3): 47-52, Baishideng Publishing Group, United States (Aug. 2013).
Foditsch, C., et al., "Isolation and Characterization of Faecalibacterium prausnitzii from Calves and Piglets," PLOS One, 9(12):e116465, Public Library of Science, United States (Dec. 31, 2014).
Fonseca, F., et al., "Operating Conditions That Affect the Resistance of Lactic Acid Bacteria to Freezing and Frozen Storage," Cryobiology, 43(3):189-198, Elsevier, Netherlands (Nov. 2001).
Frank, D.N., et al., "Molecular-phylogenetic Characterization of Microbial Community Imbalances in Human Inflammatory Bowel Diseases," Proceedings of the National Academy of Sciences of the United States of America 104(34):13780-13785, National Academy of Sciences, United States (Aug. 2007).
Franz, C.M.A.P., et al., "Enterococci as Probiotics and Their Implications in Food Safety," International Journal of Food Microbiology, 151(2):125-140, Elsevier Science Publishers, Netherlands (Dec. 2011).
Freifeld et al., "Clinical Practice Guideline for the Use of Antimicrobial Agents in Neutropenic Patients with Cancer: 2010 Update by the Infectious Diseases Society of America," Clinical Infectious Diseases 52(4):e56-e93 (2011).
Friedman-Moraco, R.J., et al., "Fecal Microbiota Transplantation for Refractory Clostridium Difficile Colitis in Solid Organ Transplant Recipients.," American Journal of Transplantation, 14(2):477-480, Wiley-Blackwell on behalf of the American Society of Transplant Surgeons and the American Society of Transplantation, United States (Feb. 2014).
Fuentes, S., Van Nood, E., Tims, S., Heikamp-De Jong, 1., Ter Braak, C.J., Keller, J.J., Zoetendal, E.G., and Devos, W.M. (2014). Reset of a critically disturbed microbial ecosystem: faecal transplant in recurrent Clostridium difficile infection. The ISME Journal.
Furusawa, Y., et al., "Commensal Microbe-derived Butyrate Induces the Differentiation of Colonic Regulatory T Cells ," Nature 504(7480):446-450, Nature Publishing Group, England (Dec. 2013).
Gaboriau-Routhiau, V., et al., "The Key Role of Segmented Filamentous Bacteria in the Coordinated Maturation of Gut Helper T Cell Responses," Immunity 31(4):677-689, Cell Press, United States (Oct. 2009).
Gallo, R.L and Hooper, L.V, "Epithelial Antimicrobial Defence of the Skin and Intestine," Nature Reviews Immunology , 12(7):503-516, Nature Publishing Group, England, (Jun. 2012).
Ganesh et al., "Commensal Akkermansia muciniphila Exacerbates Gut Inflammation in *Salmonella typhimurium*-Infected Gnotobiotic Mice," PLoS ONE 8(9):e74963 (2013).
GenBank: AccessionNumber NR 118589.1, accessed on Jun. 20, 2020.
Genbank, "Clostridium scindens 16S ribosomal RNA gene, complete sequence," Accession No. AY878326.1, retrieved from URL:[https://www.ncbi.nlm.nih.gov/nuccore/AY878326] on Jul. 26, 2022, 1 page.
GenBank HQ819637, "Uncultured Organism Clone ELU0180-T56-SNIPCRAMgANa_000311 Small Subunit Ribosomal RNA Gene, Partial Sequence," Jul. 30, 2012, 1 page, [Online] [Retrieved on Aug. 21, 2014] Retrieved from the Internet (URL:http://www.ncbi.nlm.nih.gov/nuccore/HQ819637).
Geuking, M.B., et al., "Intestinal Bacterial Colonization Induces Mutualistic Regulatory T Cell Responses," Immunity 34(5):794-806, Cell Press, United States (May 2011).
Gevers, D., et al., "The Treatment-naive Microbiome in New-Onset Crohn's Disease," Cell Host & Microbe, 15(3):382-392, Cell Press, United States (Mar. 2014).
Giel, J.L., et al., "Metabolism of Bile Salts in Mice Influences Spore Germination in Clostridium Difficile," Plos One, 5(1):e8740, Public Library of Science, United States, (Jan. 2010).
Gilligan, P.H. (2013). Identification of Pathogens by Classical Clinical Tests. In The Prokaryotes, E. Rosenberg, E.F. Delong, S. Lory, E. Stackebrandt, and F. Thompson, eds. (Springer Berlin Heidelberg), pp. 57-89.
Goldberg et al., "T Cell-Depleted Stem Cell Transplantation for Adults with High-Risk Acute Lymphoblastic Leukemia: Long-Term Survival for Patients in First Complete Remission with a Decreased Risk of Graft-versus-Host Disease," Biol. Blood Marrow Transplant 19:208-213 (2013).

(56) References Cited

OTHER PUBLICATIONS

Goldspiel, B.R., et al., "Human Gene Therapy," Clinical Pharmacy 12(7):488-505, American Society Of Hospital Pharmacists, United States (1993).
Goodman, N.S., et al., "Biphasic System for Separation of Spores and Crystals of Bacillus Thuringiensis," Journal of Bacteriology, 94(2):485, American Society for Microbiology, United States (Aug. 1967).
Goodman,A.L., et al., "Extensive Personal Human Gut Microbiota Culture Collections Characterized and Manipulated in Gnotobiotic Mice," Proceedings of the National Academy of Sciences of the United States of America 108(15):6252-6257, National Academy of Sciences, United States (Apr. 2011).
Gough, E., et al., "Systematic Review of Intestinal Microbiota Transplantation (Fecal Bacteriotherapy) for Recurrent Clostridium Difficile Infection," Clinical Infectious Diseases, 53(10):994-1002, The University of Chicago Press, United States (Nov. 2011).
Gould, G.W., and Sale, A.J, "Initiation of Germination of Bacterial Spores by Hydrostatic Pressure," Journal of General Microbiology, 60(3):335-346, Society for General Microbiology, England (Mar. 1970).
Grabow, W.O., et al., "Elimination of Viruses, Phages, Bacteria and Cryptosporidium by a New Generation Aquaguard Point-of-use Water Treatment Unit," International Journal of Hygiene and Environmental Medicine, 202(5):399-410, Gustav Fischer Verlag, Germany (Sep. 1999).
Grangette et al., "Enhanced antiinflammatory capacity of a Lactobacillus plantarum mutant synthesizing modified teichoic acids," PNAS 102(29): 10321-10326 (2005).
Greenway, F., et al., "A Novel Cobiotic Containing a Prebiotic and an Antioxidant Augments the Glucose Control and Gastrointestinal Tolerability of Metformin: A Case Report," Beneficial Microbes, 5(1):29-32, Wageningen Academic Publishers, Netherlands (Mar. 2014).
Grehan, M.J., et al., "Durable Alteration of the Colonic Microbiota by the Administration of Donor Fecal Flora, " Journal of Clinical Gastroenterology 44(8):551-561, Wolters Kluwer Health, Inc, United States (Sep. 2010).
Grimoud, J., et al., "In Vitro Screening of Probiotic Lactic Acid Bacteria and Prebiotic Glucooligosaccharides to Select Effective Synbiotics," Anaerobe, 16(5):493-500, Academic Press, England (Oct. 2010).
Gupta, R.K., et al., "Differentiation Between Heat Resistance and Octyl Alcohol Resistance of the Cells of Bacillus Cereus T," Biochemical and Biophysical Research Communications, 38(1):23-30, Elsevier, United States (Jan. 1970).
Gut definition. Merriam Webster Dictionary. https://www.merriamwebster. com/dictionary/gut, retrieved Mar. 9, 2020.
Hahn et al., "Risk factors for Acute Graft-Versus-Host Disease after Human Leukocyte Antigen-Identical Sibling Transplants for Adults With Leukemia," J Clin. Oncol. 26(35):5728-5734 (2008).
Hall, B.G., et al., "Building Phylogenetic Trees From Molecular Data With Mega," Molecular biology and Evolution, 30(5):1229-1235, Oxford University Press, United States, (May 2013).
Halmann, M., et al., "Stages in Germination of Spores of Bacillus Licheniformis," Journal of Bacteriology, 84(6):1187-1193, American Society for Microbiology, United States (Dec. 1962).
Hamil Ton, M.J., et al., "Standardized Frozen Preparation for Transplantation of Fecal Microbiota for Recurrent Clostridium Difficile Infection," The American Journal of Gastroenterology, 107(5):761-767, Wolters Kluwer Health, United States (May 2012).
Hamilton, M.J., et al., "High-throughput Dna Sequence Analysis Reveals Stable Engraftment of Gut Microbiota Following Transplantation of Previously Frozen Fecal Bacteria," Gut Microbes, 4(2):125-135, Philadelphia, United States, (Mar.-Apr. 2013).
Hand, T.W., et al., "Acute Gastrointestinal Infection Induces Long-lived Microbiota-specific T Cell Responses," Science, 337(6101): 1553-1556, American Association for the Advancement of Science, United States, (Sep. 2012).
Hansen, A.K. et al., "Handbook of Laboratory Animal Bacteriology," Second Edition, CRC Press, 2015, p. 158 (3 total pages).
Harmsen, H. J. M., et al., "Comparison of Viable Cell Counts and Fluorescence in Situ Hybridization Using Specific rRNA-based Probes for the Quantification of Human Fecal Bacteria," FEMS Microbiology Letters, 183(1):125-129, Oxford Oxford University Press, England (Feb. 2000).
Harrison, F, "Bacterial Cooperation in the Wild and in the Clinic: Are Pathogen Social Behaviours Relevant Outside the Laboratory?," BioEssays , 35(2):108-112, Wiley, United States (Feb. 2013).
Hasan, J.A., et al., "In Vitro Production of Clostridium Difficile Spores for Use in the Efficacy Evaluation of Disinfectants: a Precollaborative Investigation," Journal of AOAC International, 94(1):259-272, Aoac International, United States (Jan. 2011).
Hata, D.J et al., "Blood Group B Degrading Activity of Ruminococcus Gnavus Alpha-Galactosidase," Artif. Cells Blood Substit. Immobil. Biotechnol., May 2004, pp. 263-274, vol. 32, No. 2.
Hayashi, H., et al., "Phylogenetic Analysis of the Human Gut Microbiota Using 16s Rdna Clone Libraries and Strictly Anaerobic Culture-based Methods," Microbiology and Immunology 46(8):535-548, Wiley-Blackwell, Australia (2002).
Hayashi, Y., et al., "Western Blot (Immunoblot) Assay of Small, Round-structured Virus Associated With an Acute Gastroenteritis Outbreak in Tokyo," Journal of Clinical Microbiology, 27(8):1728-1733, American Society for Microbiology, United States (Aug. 1989).
Hazenberg, M.P., et al., "Conversion of Germ-free Mice to the Normal State by Clostridia," Zeitschrift für Versuchstierkunde 18(4):185-190, Gustav Fischer Verlag, Germany (1976).
Heeg, D et al., "Spores of Clostridium difficile Clinical Isolates Display a Diverse Germination Response to Bile Salts," PLoS One 7(2):e32381 (2012).
Hell, M., et al., "Probiotics in Clostridium Difficile Infection: Reviewing the Need for a Multistrain Probiotic, " Beneficial Microbes, 4(1):39-51, Wageningen Academic Publishers, Netherlands (Mar. 2013).
Hemmerling, A., et al., "Phase 2a Study Assessing Colonization Efficiency, Safety, and Acceptability of Lactobacillus crispatus CTV-05 in Women With Bacterial Vaginosis," Sexually Transmitted Diseases, 37(12):745-750 (Dec. 2010).
Herron, P.R., and Wellington, E.M.H, "New Method for Extraction of Streptomycete Spores From Soil and Application to the Study of Lysogeny in Sterile Amended and Nonsterile Soil," Applied and Environmental Microbiology, 56(5):1406-1412, American Society for Microbiology, United States (May 1990).
Hewitt, J., et al., "Evaluation of Murine Norovirus as a Surrogate for Human Norovirus and Hepatitis a Virus in Heat Inactivation Studies," Journal of Applied Microbiology, 107(1):65-71, Oxford : Published for the Society for Applied Bacteriology by Blackwell Science, England (Jul. 2009).
Hickson, M., et al., "Use of probiotic Lactobacillus preparation to prevent diarrhoea associated with antibiotics: randomised double blind placebo controlled trial," BMJ 335(7610):80, 5 pages, British Medical Association, United Kingdom (Jul. 2007).
Hickson, M., "Probiotics in the Prevention of Antibiotic-associated Diarrhoea and Clostridium Difficile Infection," Therapeutic Advances in Gastroenterology, 4(3):185-197, Sage Publications, England (May 2011).
Hiemenz, "Management of Infections Complicating Allogeneic Hematopoietic Stem Cell Transplantation," Semin Hematol 46:289-312 (2009).
Hill, D.A., et al., "Commensal bacteria-derived signals regulate basophil hematopoiesis and allergic inflammation," Nat Med., 18(4):538-546 (2012).
Hindle, A.A., and Hall, E.A.H, "Dipicolinic Acid (DPA) Assay Revisited and Appraised for Spore Detection," The Analyst, 124(11): 1599-1604 (1999).
Hirsch, E.B., and Tam, V.H, "Detection and Treatment Options for Klebsiella Pneumoniae Carbapenemases (KPCS): an Emerging Cause of Multidrug-Resistant Infection," The Journal of Antimicrobial Chemotherapy, 65(6):1119-1125, Oxford University Press, England (Jun. 2010).

(56) References Cited

OTHER PUBLICATIONS

Hofsten, B.V., "Partition of Escherichia Coli in an Aqueous Polymer Two-phase System," Experimental Cell Research, 41(1):117-123 (Jan. 1966).
Holdeman, L, V., et al., "Human Fecal Flora: Variation in Bacterial Composition Within Individuals and a Possible Effect of Emotional Stress," Applied and Environmental Microbiology 31(3):359-375, American Society for Microbiology, United States (Mar. 1976).
Holler et al., "Metagenomic Analysis of the Stool Microbiome in Patients Receiving Allogeneic Stem Cell Transplantation: Loss of Diversity Is Associated with Use of Systemic Antibiotics and More Pronounced m Gastrointestinal Graft-versus-Host Disease," Biol. Blood Marrow Transplant. 20:640-645 (2014).
Holmes, E., et al., "Therapeutic Modulation of Microbiota-Host Metabolic Interactions," Science Translational Medicine, 4(137) :137rv6, American Association for the Advancement of Science, United States (Jun. 2012).
Holt G. J., et al., "Bergey's Manual of Determinative Bacteriology," Ninth Edition, 1994, pp. 527, 531, 577, 579 (6 pages total).
Honda, K., et al., "Regulations of T cell reponses by intestinal commensal bacteria," Journal of Intestinal Microbiology 25(2):103-104, (Apr. 2011).
Hong et al., "1H NMR-based Metabonomic Assessment of Probiotic Effects in a Colitis Mouse Model," Arch Pharm Res 33(7): 1091-1101 (2010).
Hong, H.A., et al., "The Use of Bacterial Spore Formers as Probiotics," FEMS Microbiology Reviews 29(4):813-835, Oxford University Press, England (Sep. 2005).
Hoppe, B., et al., "Efficacy and Safety of Oxalobacter Formigenes to Reduce Urinary Oxalate in Primary Hyperoxaluria," Nephrology, Dialysis, Transplantation, 26(11):3609-3615, Oxford University Press, England (Nov. 2011).
Hoyles, L., et al., "Recognition of Greater Diversity of *Bacillus* Species and Related Bacteria in Human Faeces," Research in Microbiology, 163(1):3-13, Elsevier, France (Jan. 2012).
Hue et al., "Interleukin-23 drives innate and T cell-mediated intestinal inflammation," JEM 203(11):2473-2483 (2006).
Human Microbiome Project Consortium, "Structure, Function and Diversity of the Healthy Human Microbiome," Nature, 486(7402):207-214, Nature Publishing Group, England (Jun. 2012).
Hurst, C.J., and Gerba, C.P, "Fate of Viruses During Wastewater Sludge Treatment Processes," Critical Reviews in Environmental Control, 18(4):317-343 (Jan. 2009).
Huse, S.M., et al., "Exploring Microbial Diversity and Taxonomy Using Ssu Irna Hypervariable Tag Sequencing," PLoS Genetics 4(11):e1000255, Public Library of Science, United States (Nov. 2008).
ICI Wrap-up Report Immunology in the 21st Century: Defeating Infection, Autoimmunity, Allergy and Cancer, 14th International Congress of Immunology, Aug. 22-27, 2010, Japan, 1 page.
International Search Report and Patentability for Application No. PCT/US2016/063697, mailed on May 29, 2018, Button et al., "Designed Bacterial Compositions," filed Nov. 23, 2016, 27 pages.
International Search Report and Written Opinion for Application No. PCT/US2016/041538, mailed on Sep. 23, 2016, Cook., et al., "Methods of Treating Colitis," filed Jul. 8, 2016, 12 Pages.
International Search Report and Written Opinion for International Application No. PCT/US13/71758, Alexandria, Virginia, mailed on May 5, 2014, 37 pages.
International Search Report and Written Opinion for International Application No. PCT/US14/14738, Alexandria, Virginia, mailed on Jul. 30, 2014, 26 pages.
International Search Report and Written Opinion for International Application No. PCT/US14/14744, Alexandria, Virginia, mailed on May 21, 2014, 26 pages.
International Search Report and Written Opinion for International Application No. PCT/US14/14745, Alexandria, Virginia, mailed on Jul. 30, 2014, 25 pages.
International Search Report and Written Opinion for International Application No. PCT/US14/14747, Alexandria, Virginia, mailed on Jun. 13, 2014, 17 pages.
International Search Report and Written Opinion for International Application No. PCT/US14/70684, Alexandria, Virginia, mailed on Jun. 10, 2015, 11 pages.
International Search Report and Written Opinion for International Application No. PCT/US2014/029539, Alexandria, Virginia, mailed on Oct. 10, 2014, 12 pages.
International Search Report and Written Opinion for International Application No. PCT/US2014/030817, Alexandria, Virginia, mailed on Dec. 5, 2014, 15 pages.
International Search Report and Written Opinion for International Application No. PCT/US2014/067491, European Patent Office, H V Rijswijk, mailed on Apr. 2, 2015, 12 pages.
International Search Report and Written Opinion for International Application No. PCT/US2016/063697, European Patent Office, H V Rijswijk, mailed on May 19, 2017, 24 pages.
International Search Report and Written Opinion for International Application No. PCT/US2019/025010, European Patent Office, Netherlands, mailed on Jul. 11, 2019.
International Search Report dated Apr. 14, 2016 in International Application No. PCT/US2015/062734.
International Search Report for International Application No. PCT/US2015/31627, ISA/US, Commissioner for Patents, Alexandria, Virginia, mailed on Sep. 8, 2015.
International Statistical Classification of Diseases and Related Health Problems 1 O'h Review, Chapter 1: Certain Infectious and Parasitic Diseases (AOO-B99), 2016, 2 pages.
Israel Office Action, Israel Application No. 238973, Apr. 20, 2017, 4 pages (with concise explanation of relevance).
Itoh, K., et al., "Characterization of Clostridia Isolated From Faeces of Limited Flora Mice and Their Effect on Caecal Size When Associated With Germ-Free Mice," Laboratory Animals 19(2):111-118, Sage, England (Apr. 1985 ).
Itoh, K., et al., "Colonization Resistance Against Pseudomonas Aeruginosa in Gnotobiotic Mice," Laboratory Animals 20(3):197-201, Laboratory Animals Ltd, England (Jul. 1986).
Itoh, K., et al., "Intestinal Bacteria Antagonistic to Clostridium Difficile in Mice," Laboratory Animals 21(1):20-25, Laboratory Animals Ltd, England (Jan. 1987).
Ivanov, I.I., et al., "Induction of intestinal Th 17 cells by segmented filamentous bacteria," Cell, 139(3):485-498 (2009).
Ivanov, I.I., et al., "Specific Microbiota Direct the Differentiation of Il-17-Producing T-Helper Cells in the Mucosa of the Small Intestine," Cell Host Microbe 4(4):337-349, Cell Press, United States (Oct. 2008) including supplemental data.
Jacobs et al., "1H NMR metabolite profiling of feces as a tool to assess the impact of nutrition on the human microbiome," NMR in Biomedicine 21:615-626 (2008).
Jaffe et al., "Prevention of Peritransplantation Viridans Streptococcal Bacteremia with Early Vancomycin Administration: A Single-Center Observational Cohort Study," Clin Infect Dis. 39:1625-1632 (2004).
Jagasia et al., "Risk factors for acute GVHD and survival after hematopoietic cell transplantation," Blood 119(1):296-307 (2012).
Jakubowski et al., "T Cell-Depleted Unrelated Donor Stem Cell Transplantation Provides Favorable Disease-Free Survival for Adults with Hematologic Malignancies," Biol. Blood Marrow Transplant 17:1335-1342 (2011).
Jalanka-Tuovinen, J., Salojarvi, J., Salonen, A., Immonen, 0., Garsed, K., Kelly, F.M., Zaitoun, A., Palva, A., Spiller, R.C., and Devos, W.M. (2013). Faecal microbiota composition and host-microbe cross-talk following gastroenteritis and in postinfectious irritable bowel syndrome. Gut 0, 1-9.
Janda, J.M., et al., "16S rRNA Gene Sequencing for Bacterial Identification in the Diagnostic Laboratory: Pluses, Perils, and Pitfalls," Journal of Clinical Microbiology, 45(9):2761-2764, American Society for Microbiology, United States (Sep. 2007).
Janeway, C.A. et al., "Autoimmune Responses are Directed Against Self Antigens," Immunobiology: The Immune System in Health and Disease, 51th Edition, Garland Science, 2001, pp. 1-14.

(56) References Cited

OTHER PUBLICATIONS

Janeway, C.A. et al., Immuno Biology, 61th Edition, Garland Science Publishing, 2005, p. 414.
Japanese First Office Action, Japanese Application No. 2015-544179, Sep. 19, 2017, 8 pages.
Japanese Office Action, Japanese Application No. 2015-556240, Jun. 5, 2018, 5 pages.
Japanese Office Action, Japanese Application No. 2015-556240, Oct. 3, 2017, 8 pages.
Japanese Office Action, Japanese Application No. 2015-556241, Sep. 26, 2017, 12 pages.
Japanese Office Action, Japanese Application No. JP2016-502561, Feb. 6, 2018, 10 pages.
Jarry, A., et al., "Mucosal IL-10 and TGF-Beta Play Crucial Roles in Preventing LPS-driven, IFN-gamma-mediated Epithelial Damage in Human Colon Explants," The Journal of Clinical Investigation, 118(3):1132-1142, American Society for Clinical Investigation, United States (Mar. 2008).
Jawetz, et al., "Chapter 11: Spore-Forming Gram-Positive Bacilli: Bacillus and *Clostridium* Species," Jawetz, Melnick&Adelberg's Medical Microbiology, 26e:1-15 (Mar. 7, 2017).
Jeffs, L.B., and Khachatourians, G.G, "Estimation of Spore Hydrophobicity for Members of the Genera Beauveria, Metarhizium, and Tolypocladium by Salt-mediated Aggregation and Sedimentation," Canadian Journal of Microbiology, 43(1):23-28 (1997).
Jenq et al., "Intestinal Blautia Is Associated with Reduced Death from Graft-versus-Host Disease," Biology of Blood and Marrow Transplantation 21:1373-1383 (2015).
Jenq et al., "Regulation of intestinal inflammation by microbiota following allogeneic bone marrow transplantation," J Exp. Med. 209(5):903-911 (2012).
Jensen, N.S., and Canale-Parola, E, "Bacteroides *Pectinophilus* Sp. Nov. and Bacteroides *Galacturonicus* Sp. Nov.: Two Pectinolytic Bacteria From the Human Intestinal Tract.," Applied and Environmental Microbiology, 52(4):880-887, American Society for Microbiology, United States (Oct. 1986).
Johansson et al., "The two mucus layers of colon are organized by the MUC2 mucin, whereas the outer layer is a legislator of host-microbial interactions," PNAS 108(Suppl. 1):4659-4665 (2011).
Johnson, S., et al., "Is Primary Prevention of Clostridium Difficile Infection Possible With Specific Probiotics?," International Journal of Infectious Diseases, 16(11):e786-e792, Elsevier, Canada (Nov. 2012).
Johnston, R., et al., "Method To Facilitate the Isolation of Clostridium Botulinum Type E," Journal of Bacteriology, 88(5):1521-1522, American Society for Microbiology, United States (Nov. 1964).
Jones et al., "Mortality and Gross Pathology of Secondary Disease in Germfree Mouse Radiation Chimeras," Radiat Res. 45(3):577-588 (1971).
Jones, M.L., et al., "Cholesterol Lowering and Inhibition of Sterol Absorption by Lactobacillus Reuteri NCIMB 30242: a Randomized Controlled Trial," European Journal of Clinical Nutrition, 66(11):1234-1241, Nature Publishing Group, England (Nov. 2012).
Jones, M.L., et al., "Cholesterol-lowering Efficacy of a Microencapsulated Bile Salt Hydrolase-active Lactobacillus Reuteri Ncimb 30242 Yoghurt Formulation in Hypercholesterolaemic Adults.," The British Journal of Nutrition, 107(10):1505-1513, Wallingford, England (May 2012).
Joosten, H., et al., "*Salmonella* Detection in Probiotic Products," International Journal of Food Microbiology, 110(1):104-107, Elsevier Science Publishers, Netherlands (Jul. 2006).
Jordan, F., et al., "Network Ecology: Topological Constraints on Ecosystem Dynamics," Physics of Life Reviews, 1(3): 139-172, (Dec. 2004).
Jorgensen, J.H., and Ferraro, M.J, "Antimicrobial Susceptibility Testing: a Review of General Principles and Contemporary Practices," Clinical Infectious Diseases, 49(11):1749-1755, Oxford University Press, United States (Dec. 2009).
Jorup-Ronstrom, C., et al., "Fecal Transplant Against Relapsing Clostridium Difficile-associated Diarrhea in 32 Patients," Scandinavian Journal of Gastroenterology, 47(5):548-552, Informa Healthcare, England (May 2012).
Jousimies-Somer, H., Summanen, P., Citron, D.M., Baron, E.J., Wexler, H.M., and Finegold, S.M. (2002). Wadsworth-KLT Anaerobic Bacteriology Manual, 6th edition (California: Star), pp. 55-74, 81-132, 165-185.
Kabeerdoss, J., et al., "Clostridium Leptum Group Bacteria Abundance and Diversity in the Fecal Microbiota of Patients With Inflammatory Bowel Disease: A Case-control Study in India," BMC Gastroenterology 13:20, BioMed Central, England (Jan. 2013).
Kailasapathy, K., "Microencapsulation of Probiotic Bacteria: Technology and Potential Applications," Current Issues in Intestinal Microbiology, 3(2):39-48, Horizon Scientific Press, England (Sep. 2002).
Kakihana, K., et al., "Fecal Microbiota Transplantation for Patients with Steroid-Resistant Acute Graft-Versus-Host Disease of the Gut," Blood 128(16):2083-2088, American Society of Hematology, United States (Oct. 2016).
Kamboj et al., "Clostridium difficile Infection after Allogeneic Hematopoietic Stem Cell Transplant: Strain Diversity and Outcomes Associated with NAP1/027," Biol. Blood Marrow Transplant 20:1626-1633 (2014).
Kamboj et al., "The Changing Epidemiology of Vancomycin-Resistant Enterococcus (VRE) Bacteremia m Allogeneic Hematopoietic Stem Cell Transplant (HSCT) Recipients," Biol Blood Marrow Transplant 16:1576-1581 (2010).
Kaminski, J., et al., "High-Specificity Targeted Functional Profiling in Microbial Communities with ShortBRED," PLOS Computational Biology 11(12):e1004557, Public Library of Science, United States (Dec. 2015).
Kamiya, S., et al., "Recovery of Spores of Clostridium Difficile Altered by Heat or Alkali," Journal of Medical Microbiology, 28(3):217-221, Microbiology Society, England (Mar. 1989).
Kanamoto, T. et al., "Genetic Heterogeneities and Phenotypic Characteristics of Strains of The Genus *Abiotrophia* and Proposal of *Abiotrophia para-adiacens* sp. nov.," Journal of Clinical Microbiology, Feb. 2000, pp. 492-498, vol. 38, No. 2; Abiotropia para-adjacens gene for 16S rRNA, partial sequence, strain: Nucleotide: NCBI: GenBank: AB022027.1, last accessed Mar. 12, 2014, p. 8.
Kanehisa Laboratories. Kegg: Kyoto encyclopedia of genes and genomes. (http://www.genome.jp/kegg/); Accessed Mar. 27, 2014.
Kang, D.J., et al., "Clostridium scindens baiCD and baiH genes encode stereo-specific 7a/7~-hydroxy-3-oxo-114-cholenoic acid oxidoreductases," Biochim Biophys Acta 1781(1-2): 16-25 (2008).
Karasawa, T., et al., "A Defined Growth Medium for Clostridium Difficile," Microbiology, 141 (2):371-375, Kluwer Academic/Plenum Publishers, United States (Feb. 1995).
Kazamias, M. and Sperry, J, "Enhanced Fermentation of Mannitol and Release of Cytotoxin by Clostridium Difficile in Alkaline Culture Media," Applied and Environmental Microbiology, 61(6):2425-2427, American Society for Microbiology, United States (Jun. 1995).
Kelly, D., et al., "Commensal Anaerobic Gut Bacteria Attenuate Inflammation by Regulating Nuclear-cytoplasmic Shuttling of PPAR-gamma and Rela," Nature Immunology, 5(1):104-112, Nature America Incorporated, United States (Jan. 2004).
Kelly, D., et al., "Commensal Gut Bacteria: Mechanisms of Immune Modulation ," Trends in Immunology 26(6):326-333, Elsevier Science Ltd, England (Jun. 2005).
Keynan, Y., et al., "The Role of Regulatory T Cells in Chronic and Acute Viral Infections," Clinical Infectious Diseases 46(7):1046-1052, Oxford University Press, United states (Apr. 2008).
Khoruts, A. (2013). How Does Fecal Microbiota Transplantation Treat Clostridium difficile Infection? (https://www.genome.gov/Multimedia/Siides/HumanMicrobiomeScience2013/39_Khor uts.pdf) Accessed Mar. 21, 2014.
Khoruts, A., and Sadowsky, M.J, "Therapeutic Transplantation of the Distal Gut Microbiota, " Mucosal Immunology, 4(1):4-7, Nature Publishing Group, United States (Jan. 2011).
Khoruts, A., et al., "Changes in the Composition of the Human Fecal Microbiome After Bacteriotherapy for Recurrent Clostridium Difficile-

(56) References Cited

OTHER PUBLICATIONS associated Diarrhea," Journal of Clinical Gastroenterology 44(5):354-360, Wolters Kluwer Health, United states (May 2010 ).
Kim, B., et al., "Bacteraemia Due to Tribe Proteeae: a Review of 132 Cases During a Decade (1991-2000)," Scandinavian Journal of Infectious Diseases, 35(2):98-103, nforma Healthcare, England (2003).
Kim, J.Y., et al., "Effect of Oral Probiotics (Bifidobacterium Lactis AD011 and Lactobacillus Acidophilus AD031) Administration on Ovalbumin-induced Food Allergy Mouse Model," Journal of Microbiology and Biotechnology, 18(8):1393-1400, Korean Society for Microbiology and Biotechnology, Korea (Aug. 2008).
Kim, S.W., et al., "Treatment of Refractory or Recurrent Clostridium Difficile Infection," The Korean Journal of Gastroenterology = Taehan Sohwagi Hakhoe Chi, 60(2):71-78, Korean Society of Gastroenterology, [2003],Korea (South), (Aug. 2012).
Kinnebrew, M.A., et al., "Early Clostridium Difficile Infection During Allogeneic Hematopoietic Stem Cell Transplantation," Plos One, 9(3):e90158, Public Library of Science, United States, (Mar. 2014).
Kitahara, M., et al., "Assignment of *Eubacterium* sp. VPI 12708 and Related Strains with High Bile Acid 7alpha-dehydroxylating Activity to Clostridium Scindens and Proposal of *Clostridium hylemonae* sp. nov., Isolated from Human Faeces," International Journal of Systematic and Evolutionary Microbiology 50(3):971-978, Microbiology Society, England (May 2000).
Klayraung, S., et al., "Development of Tablets Containing Probiotics: Effects of Formulation and Processing Parameters on Bacterial Viability," International Journal of Pharmaceutics, 370(1-2):54-60, Elsevier/North-Holland Biomedical Press, Netherlands (Mar. 2009).
Koeth, R.A., et al., "Intestinal Microbiota Metabolism of L-carnitine, a Nutrient in Red Meat, Promotes Atherosclerosis," Nature Medicine, 19(5):576-585, Nature Publishing Company, United States, (May 2013).
Kollmann, M., et al., "Design Principles of a Bacterial Signalling Network," Nature, 438(7067):504-507, Nature Publishing Group, England (Nov. 2005).
Kong, Q., et al., "Oral Administration of Clostridium Butyricum for Modulating Gastrointestinal Microflora in Mice," Current Microbiology, 62(2):512-517, Springer International, United States (Feb. 2011).
Konstantinidis, K.T., et al., "The Bacterial Species Definition in the Genomic Era," Philosophical Transactions of the Royal Society of London. Series B, Biological Sciences, 361(1475):1929-1940, Royal Society, England (Nov. 2006).
Koonin, E.V. (2002). Chapter 22 The clusters of orthologous groups (COGS) database: Phylogenetic classification of proteins from complete genomes. (http://www.ncbi.nlm.nih.gov/books/NBK21090/pdf/ch22.pdf) Accessed Mar. 27, 2014.
Koransky, J. R., et al., "Use of ethanol for selective isolation of sporeforming microorganisms," Appl Environ Microbiol 35(4):762-765, American Society for Microbiology, United States (Apr. 1978).
Kort, R., et al., "Assessment of Heat Resistance of Bacterial Spores from Food Product Isolates by Fluorescence Monitoring of Dipicolinic Acid Release," Applied and Environmental Microbiology, 71 (7):3556-3564 (2005).
Krishna, S.G., et al., "Risk Factors, Preemptive Therapy, and Antiperistaltic Agents for Clostridium Difficile Infection in Cancer Patients," Transplant Infectious Disease, 15(5):493-501, Munksgaard, Denmark, (Oct. 2013 ).
Krogius-Kurikka, L., et al., "Sequence Analysis of Percent G+C Fraction Libraries of Human Faecal Bacterial Dna Reveals a High Number of Actinobacteria," BMC Microbiology 9:68, BioMed Central, England (Apr. 2009).
Kron et al., "Adenovirus Vectors and Subviral Particles for Protein and Peptide Delivery," Curr Gene Ther 12:362-373 (2012).
Kucerova, Z., et al., "Purification of Enterocytozoon bieneusi Spores from Stool Specimens by Gradient and Cell Sorting Techniques," Journal of Clinical Microbiology, 42(7):3256-3261 (2004).
Kumar, M., et al., "Cholesterol-lowering Probiotics as Potential Biotherapeutics for Metabolic Diseases," Experimental Diabetes Research, 2012:902917, Hindawi Publishing Corporation, United States (2012).
Kump, P.K., et al., "Alteration of Intestinal Dysbiosis by Fecal Microbiota Transplantation Does Not Induce Remission in Patients With Chronic Active Ulcerative Colitis," Inflammatory Bowel Disease, 19(10):2155-2165, Oxford University Press, England (Sep. 2013).
Kunde, S., et al., "Safety, Tolerability, and Clinical Response After Fecal Transplantation in Children and Young Adults With Ulcerative Colitis," Journal of Pediatric Gastroenterology and Nutrition, 56(6):597-601, Lippincott Williams & Wilkins, United States (Jun. 2013).
Kyne, L., et al., "Health Care Costs and Mortality Associated With Nosocomial Diarrhea Due to Clostridium Difficile," Clinical Infectious Diseases, 34(3):346-353, Oxford University Press, United States, (Feb. 2002 ).
Landy, J., et al., "Review Article: Faecal Transplantation Therapy for Gastrointestinal Disease," Alimentary pharmacology & therapeutics 34(4):409-415, Wiley-Blackwell, England (Aug. 2011).
Langille, M.G., et al., "Predictive Functional Profiling of Microbial Communities Using 16s Rrna Marker Gene Sequences," Nature 2biotechnology, 31(9):814-821, Nature America Publishing, United States, (Sep. 2013).
Langrish et al., "IL-12 and IL-23: master regulators of innate and adaptive immunity," Immunological Reviews 202:96-105 (2004).
LaRocco et al., "Infection in the Bone Marrow Transplant Recipient and Role of the Microbiology Laboratory in Clinical Transplantation," Clinical Microbiology Reviews 1 0(2):277-297 (1997).
Lathrop, S.K., et al., "Peripheral Education of the Immune System by Colonic Commensal Microbiota," Nature, 478(7368):250-254, Nature Publishing Group, England, (Sep. 2011 ).
Lau, S.K.P., et al., "Bacteraemia Caused By Anaerotruncus Colihominis and Emended Description of the Species," Clinical Pathology 59(7):748-752, BMJ Pub. Group, England (Jul. 2006).
Lawley, T.D., et al., "Targeted Restoration of the Intestinal Microbiota With a Simple, Defined Bacteriotherapy Resolves Relapsing Clostridium Difficile Disease in Mice," PLoS Pathogens 8(10):e1002995, Public Library of Science, United States (Oct. 2012).
Lawson, P.A., "Anaerotruncus," Bergey's Manual of Systematics of Archaea and Bacteria, Bergey's Manual Trust, 2009, pp. 1-4.
Lawson, P.A., et al., "*Anaerotruncus colihominis* Gen. Nov., Sp. Nov., from Human Faeces," International Journal of Systematic and Evolutionary Microbiology 54(Pt 2):413-417, Microbiology Society, England (Mar. 2004).
Lee, I.K., and Liu, J.W., "Clinical Characteristics and Risk Factors for Mortality in Morganella Morganii Bacteremia," Journal of Microbiology, Immunology and Infection, 39(4):328-334, Elsevier for the Taiwan Society of Microbiology, England (Aug. 2006).
Lee, J.S., et al., "Survival of Freeze-dried Lactobacillus Bulgaricus KFRI 673 in Chitosan-coated Calcium Alginate Microparticles," Journal of Agricultural and Food Chemistry, 52(24):7300-7305, American Chemical Society, United States (Dec. 2004).
Lee, M., et al., "Synthetic Peptidoglycan Motifs for Germination of Bacterial Spores," ChemBioChem, 11(18):2525-2529, Wiley-VCH Verlag, Germany (Dec. 2010).
Lehar, J., et al., "Chemical Combination Effects Predict Connectivity in Biological Systems," Molecular Systems Biology, 3:1-14, Wiley Blackwell, England (Feb. 2007).
Lemon, K.P., et al., "Microbiota-targeted Therapies: an Ecological Perspective," Science Translational Medicine, 4(137):137rv5, American Association for the Advancement of Science, United States (Jun. 2012).
Leslie, S.B., et al., "Trehalose and Sucrose Protect Both Membranes and Proteins in Intact Bacteria During Drying," Applied and Environmental Microbiology 61(10):3592-3597, American Society for Microbiology, United States (Oct. 1995).
Liggins, M., et al., "Progesterone Analogs Influence Germination of Clostridium Sordellii and Clostridium Difficile Spores in Vitro," Journal of Bacteriology, 193(11):2776-2783, American Society for Microbiology, United States (Jun. 2011).

(56) References Cited

OTHER PUBLICATIONS

Lindner et al., "Diversification of memory B cells drives the continuous adaptation of secretory antibodies to gut microbiota," Nature Immunology 16(8):880-890 (2015).
Lindsay, J.A., et al., "Protoplast Water Content of Bacterial Spores Determined by Buoyant Density Sedimentation," Journal of Bacteriology, 163(2):735-737, American Society for Microbiology, United States (Aug. 1985).
Liu, B and Pop, M., "ARDB—Antibiotic Resistance Genes Database," Nucleic Acids Research 37(Database issue):D443-D447, Oxford University Press, England (Jan. 2009).
Liu, C., et al., "Reclassification of Clostridium Coccoides, Ruminococcus Hansenii, Ruminococcus Hydrogenotrophicus, Ruminococcus Luti, Ruminococcus Productus and Ruminococcus Schinkii as *Blautia coccoides* Gen. Nov., Comb. Nov., Blautia Hansenii Comb. Nov., Blautia Hydrogenotrophica Comb. Nov., Blautia Luti Comb. Nov., Blautia Producta Comb. Nov., Blautia Schinkii Comb. Nov. and Description of *Blautia wexlerae* Sp. Nov., Isolated From Human Faeces," International Journal of Systematic and Evolutionary Microbiology 58(Pt 8):1896-1902, Microbiology Society, England (Aug. 2008).
Liu, K., et al., "RAxML and FastTree: Comparing Two Methods for Large-scale Maximum Likelihood Phylogeny Estimation," PloS One, 6(11):e27731, Public Library of Science, United States (2011).
Livingston, S.J., et al., "New Medium for Selection and Presumptive Identification of the Bacteroides Fragilis Group," Journal of Clinical Microbiology, 7(5):448-453, American Society for Microbiology, United States (May 1978).
Lizuka, M., et al., "Elemental Diet Modulates the Growth of Clostridium Difficile in the Gut Flora," Alimentary Pharmacology & Therapeutics, 20(1):151-157, Wiley-Blackwell, England (Jul. 2004).
Li, A.D., et al., "Clinical Features and Bacterial Culture on Stools of Patients with Acute Diarrhea," Chinese Journal of Health Laboratory Technology, 2(6):559-561 (Mar. 2012).
Lodish, H et al., "Viruses: Structure, Function, and Uses," Molecular Cell Biology, 41h Edition, 2000, pp. 1-12.
Loeffler, J.P., et al., "Gene Transfer Into Primary and Established Mammalian Cell Lines With Lipopolyamine-coated DNA," Methods in Enzymology 217:599-618, Academic Press, United States (1993).
Logan, N.A., "Bacillus and Relatives in Foodborne Illness," Journal of Applied Microbiology, 112(3):417-429, Published for the Society for Applied Bacteriology by Blackwell Science, England (Mar. 2012).
Lopetuso, L.R., et al., "Commensal Clostridia: Leading Players in the Maintenance of Gut Homeostasis," Gut Pathogens, 5(1):23, BioMed Central, England (Aug. 2013).
Louie, T.J., et al., "Tolevamer, a Novel Nonantibiotic Polymer, Compared With Vancomycin in the Treatment of Mild to Moderately Severe Clostridium Difficile-associated Diarrhea," Clinical Infectious Diseases, 43(4):411-420, Oxford University Press, United States, (Aug. 2006).
Louis, P and Flint, H.J., "Diversity, Metabolism and Microbial Ecology of Butyrate-producing Bacteria From the Human Large Intestine," FEMS Microbiology Letters 294(1):1-8, Oxford University Press, England (May 2009).
Lozupone, C and Knight, R., "UniFrac: a New Phylogenetic Method for Comparing Microbial Communities," Applied and Environmental Microbiology 71(12):8228-8235, American Society for Microbiology, United States (Dec. 2005).
Lozupone, C., et al., "Identifying Genomic and Metabolic Features That Can Underlie Early Successional and Opportunistic Lifestyles of Human Gut Symbionts," Genome Research, 22(10):1974-1984, Cold Spring Harbor Laboratory Press, United States (Oct. 2012).
Lozupone et al., "UniFrac—An online tool for comparing microbial community diversity in a phylogenetic context," BMC Bioinformatics 7:371 (2006).
Machine Translation of PCT Specification, PCT Application No. PCT/JP201 0/071746, Filed Dec. 3, 2010, 79 pages.
MacMillan et al., "What predicts high risk acute graft-versus-host disease (GVHD) at onset?: identification of those at highest risk by a novel acute GVHD risk score," Br. J. Haematol 157:732-741 (2012).
MacPherson, A.J and Uhr, T., "Induction of Protective Iga by Intestinal Dendritic Cells Carrying Commensal Bacteria," Science, 303(5664):1662-1665, American Association for the Advancement of Science, United States, (Mar. 2004).
Magurran, "Measuring Biological Diversity," Malden, MA: Blackwell Publishing; 2004.
Maizels, R.M. and Smith, K.A., "Regulatory T Cells in Infection," Advances in Immunology 112:73-136, Academic Press, United states (2011).
Malard et al., "Impact of Cyclosporine—A Concentration on the Incidence of Severe Acute Graft-Versus-Host Disease after Allogeneic Stem Cell Transplantation," Biol. Blood Marrow Transplant 16:28-34 (2010).
Malik, K.A., "A New Freeze-drying Method for the Preservation of Nitrogen-fixing and Other Fragile Bacteria," Journal of Microbiological Methods, 8(5):259-271, Elsevier, Netherlands (Mar. 1988).
Manafi, M. Handbook of Culture Media for Food and Water Microbiology, 3rd Edition, Janet E.L. Corry et al., 2012, pp. 223-260.
Manges, A.R., et al., "Comparative Metagenomic Study of Alterations to the Intestinal Microbiota and Risk of Nosocomial Clostridum Difficile-associated Disease," The Journal of Infectious Diseases, 202(12):1877-1884, Oxford University Press, United States, (Dec. 2010).
Manichanh, C. et al., "Reshaping the Gut Microbiome with Bacterial Transplantation and Antibiotic Intake," Genome Research, 2010, pp. 1411-1419, vol. 20.
Manichanh, C., "Reduced Diversity of Faecal Microbiota in Crohn's Disease Revealed by a Metagenomic Approach," Gut, 55(2):205-211, British Medical Assn, England (Feb. 2006).
Marcus et al., "Deoxycholic acid and the pathogenesis of gall stones," Gut, 29, 522-533, BMJ Publishing Group, England (1988).
Marra, A., "Animal Models in Drug Development for MRSA," Methods in Molecular Biology 1085:333-345, Humana Press, United States (2014).
Marsh, J.W., et al., "Association of Relapse of Clostridium Difficile Disease With Bi/nap1/027," Journal of Clinical Microbiology, 50(12):4078-4082, American Society for Microbiology, United States, (Dec. 2012).
Martin et al., "Increasingly Frequent Diagnosis of Acute Gastrointestinal Graft-versus-Host Disease after Allogeneic Hematopoietic Cell Transplantation," Biol. Blood Marrow Transplant. 10:320-327 (2004).
Martin, F. J., and Papahadjopoulos, D., "Irreversible coupling of immunoglobulin fragments to preformed vesicles. An improved method for liposome targeting," J Biol Chem 257(1):286-288, Elsevier, Netherlands (Jan. 1982).
Martinez-Montiel, M.P., et al., "Pharmacologic Therapy for Inflammatory Bowel Disease Refractory to Steroids," Clinical and Experimental Gastroenterology 8:257-269, Dove Medical Press, New Zealand (Aug. 2015).
Maslowski, K.M. et al., "Diet, Gut Microbiota and Immune Responses," Nature Immunology, Jan. 2011, pp. 5-9, vol. 12, No. 1.
Matsuda, K. et al., "Sensitive Quantitative Detection of Commensal Bacteria by rRNA-targeted Reverse Transcription-PCR," Applied and Environmental Microbiology, 73(1):32-39, American Society for Microbiology, United States (Jan. 2007).
Maynard et al., "Reciprocal interactions of the intestinal microbiota and immune system," Nature 489:231-241 (2012).
Maziade, P.-J., et al., "Impact of adding prophylactic probiotics to a bundle of standard preventative measures for Clostridium difficile infections: enhanced and sustained decrease in the incidence and severity of infection at a community hospital," Curr Med Res Opin 29(10):1341-1347, Taylor & Francis, United Kingdom (2013).
Mbithi, J.N., et al., "Chemical Disinfection of Hepatitis a Virus on Environmental Surfaces," Applied and Environmental Microbiology, 56(11):3601-3604, American Society for Microbiology, United States (Nov. 1990).

(56) References Cited

OTHER PUBLICATIONS

McAuliffe et al., “Genetic Analysis of Two Bile Salt Hydrolase Activities in Lactobacillus acidophilus NCFM,” Appl. Environ Microbial., 71(8):4925-4929 (2005).
McFarland, L.V., and Elmer, G.W., “Pharmaceutical Probiotics for the Treatment of Anaerobic and Other Infections,” Anaerobe, 3(2-3):73-78, Academic Press, England (Apr.-Jun. 1997).
McFarland, L.V., “Use of Probiotics to Correct Dysbiosis of Normal Microbiota Following Disease or Disruptive Events: a Systematic Review,” BMJ Open, 4(8):e005047, BMJ Publishing Group Ltd, England (Aug. 2014).
McGuire, G., et al., “Models of Sequence Evolution for Dna Sequences Containing Gaps,” Molecular Biology and Evolution, 18(4):481-490, Oxford University Press, England (Apr. 2001).
McNulty, N.P., et al., “The Impact of a Consortium of Fermented Milk Strains on the Gut Microbiome of Gnotobiotic Mice and Monozygotic Twins,” Science Translational Medicine, 3(106):106ra106, American Association for the Advancement of Science, United States (Oct. 2011).
Mevissen-Verhage, E.A., et al., “Bifidobacterium, Bacteroides, and *Clostridium* Spp. in Fecal Samples From Breast-fed and Bottle-fed Infants With and Without Iron Supplement,” Journal of Clinical Microbiology, 25(2):285-289, American Society for Microbiology, United States (Feb. 1987).
Mexican Office Action, Mexican Application No. MX/a/2015/006491, Jun. 25, 2018, 8 pages, (with concise explanation of relevance).
Mexican Office Action, Mexican Application No. MX/a/2015/009991, Jul. 16, 2018, (with concise explanation of relevance).
Meyers, “Infection in Bone Marrow Transplant Recipients,” The American Journal of Medicine 81(Suppl. 1A):27-38 (1986).
Mierau, L., et al., “Industrial-scale Production and Purification of a Heterologous Protein in Lactococcus Lactis Using the Nisin-controlled Gene Expression System Nice: the Case of Lysostaphin,” Microbial Cell Factories, 4:15, BioMed Central, England (May 2005).
Miller, R.S., and Hoskins, L.C., “Mucin Degradation in Human Colon Ecosystems. Fecal Population Densities of Mucin-degrading Bacteria Estimated by a “Most Probable Number” Method,” Gastroenterology, 81(4):759-765, W.B. Saunders, United States (Oct. 1981).
Miyamoto-Shinohara, Y., et al., “Survival of Freeze-dried Bacteria,” The Journal of General and Applied Microbiology, 54(1):9-24, Microbiology Research Foundation, Japan (Feb. 2008).
M’Koma, A.E., “Inflammatory Bowel Disease: an Expanding Global Health Problem,” Clinical Medicine Insights. Gastroenterology 6:33-47, SAGE Publications, United States (Aug. 2013).
Momose, Y., et al., “16S rRNA Gene Sequence-based Analysis of Clostridia Related to Conversion of Germfree Mice to the Normal State,” Journal of Applied Microbiology 107(6):2088-2097, Blackwell Science, England (Dec. 2009).
Monte M.J., et al., “Bile Acids: Chemistry, Physiology, and Pathophysiology,” World journal of gastroenterology 15(7):804-816, WJG Press, United States (Feb. 2009).
Morgan, C.A., et al., “Preservation of Micro-organisms by Drying; a Review,” Journal of Microbiological Methods, 66(2):183-193, Elsevier Biomedical, Netherlands (Aug. 2006).
Morgan, R.A. and Anderson, W.F., “Human Gene Therapy,” Annual Review of Biochemistry 62:191-217, Annual Reviews, United States (1993).
Morris, G.N., et al., “*Clostridium scindens* sp. nov., A Human Intestinal Bacterium with Desmolytic Activity on Corticoids,” International Journal of Systematic and Evolutionary Microbiology 35(4):478-481, (Oct. 1985).
Mulligan, R.C., “The Basic Science of Gene Therapy,” Science 260(5110):926-932, American Association for the Advancement of Science, United States (1993).
Murri, M., et al., “Gut Microbiota in Children With Type 1 Diabetes Differs From That in Healthy Children: a Case-control Study,” BMC Medicine, 11:46, BioMed Central, England (Feb. 2013).
Myers, E.W. and Miller, W., “Optimal Alignments in Linear Space,” Computer Applications in the Biosciences 4(1):11-17, Oxford University Press, England (Mar. 1988).
Myllyluoma, E., et al., “Effects of Multispecies Probiotic Combination on Helicobacter Pylori Infection in Vitro,” Clinical and Vaccine Immunology, 15(9):1472-1482, American Society for Microbiology, United States (Sep. 2008).
Naaber, P., et al., “Inhibition of Clostridium Difficile Strains by Intestinal *Lactobacillus* Species,” Journal of Medical Microbiology, 53(Pt 6):551-554, Microbiology Society, England (Jun. 2004).
Narushima, S., et al., “Characterization of the 17 Strains of Regulatory T Cell-Inducing Human-Derived Clostridia,” Gut Microbes 5(3):333-339, Taylor & Francis, United States (May-Jun. 2014).
Needleman, S.B. and Wunsch, C.D., “A General Method Applicable to the Search for Similarities in the Amino Acid Sequence of Two Proteins,” Journal of Molecular Biology 48(3):443-453, Elsevier, Netherlands (Mar. 1970).
New Zealand Examination Report, New Zealand Application No. 713298, Sep. 26, 2017, 5 pages.
New Zealand First Examination Report, New Zealand Application No. 709392, Oct. 5, 2015, 7 pages.
New Zealand First Examination Report, New Zealand Application No. 711771, Nov. 23, 2015, 6 pages.
New Zealand First Examination Report, New Zealand Application No. 711773, Nov. 24, 2015, 6 pages.
New Zealand First Examination Report, New Zealand Application No. 713298, Feb. 28, 2017,6 pages.
New Zealand Fourth Examination Report, New Zealand Application No. 713298, Mar. 15, 2018, 2 pages.
New Zealand Second Examination Report, New Zealand Application No. 709392, Jun. 9, 2016, 7 pages.
New Zealand Third Examination Report, New Zealand Application No. 711771, Nov. 4, 2016, 4 pages.
New Zealand Third Examination Report, New Zealand Application No. 713298, Feb. 15, 2018, 6 pages.
Nicholson, W.L., and Law, J.F., “Method for Purification of Bacterial Endospores From Soils: Uv Resistance of Natural Sonoran Desert Soil Populations of *Bacillus* Spp. With Reference to B. Subtilis Strain 168,” Journal of Microbiological Methods, 35(1):13-21, Elsevier Biomedical, Netherlands (Feb. 1999).
NIH human microbiome project. (http://www.hmpdacc.org/); Accessed Mar. 27, 2014.
Nishio, J., Atarashi, K., Tanque, T., Baba, M., Negishi, H., Yanai, H., Honda, K., Benoist, C., Mathis, D., and Taniguchi, T. (2013). Impact ofTCR repetoire on intestinal homeostasis (Taos, NM).
Nitert, M.D., et al., “Spring: an Rct Study of Probiotics in the Prevention of Gestational Diabetes Mellitus in Overweight and Obese Women,” Bmc Pregnancy and Childbirth, 13:50, BioMed Central, England (Feb. 2013).
Nitzan, O., et al., “Role of Antibiotics for Treatment of Inflammatory Bowel Disease,” World Journal of Gastroenterology, 22(3):1078-1087, Baishideng Publishing Group, United States (Jan. 2016).
Noack, J., et al., “Dietary Guar Gum and Pectin Stimulate Intestinal Microbial Polyamine Synthesis in Rats,” The Journal of Nutrition, 128(8):1385-1391, American Society for Nutrition, United States (Aug. 1998).
Non Final Office Action mailed Apr. 7, 2020, in U.S. Appl. No. 16/054,864, Gregory McKenzie et al., filed Aug. 3, 2018, 15 pages.
Non Final Office Action mailed Mar. 15, 2019, in U.S. Appl. No. 16/054,864, Gregory McKenzie et al., filed Aug. 3, 2018, 9 pages.
Non Final Office Action mailed Nov. 3, 2016, in U.S. Appl. No. 14/777,252 , Henn, M.R., et al., filed Sep. 15, 2015.
Non Final Office Action mailed Jan. 23, 2017, in U.S. Appl. No. 14/765,810, Maltzahn, G.V., et al., filed Aug. 4, 2015.
Non Final Office Action mailed Aug. 29, 2017, in U.S. Appl. No. 14/777,252 , Henn, M.R., et al., filed Sep. 15, 2015.
Non Final Office Action mailed Apr. 17, 2018, in U.S. Appl. No. 14/765,814, 14 pages.
Non Final Office Action mailed Jun. 15, 2018, in U.S. Appl. No. 15/359,439, 13 pages.
Non final Office action mailed Mar. 21, 2019, in U.S. Appl. No. 14/765,812, Afey An; N. et al., filed Aug. 4, 2015, 10 pages.

(56) References Cited

OTHER PUBLICATIONS

Non Final Office Action mailed Mar. 23, 2017, in U.S. Appl. No. 14/776,676, 8 pages.
Non Final Office Action mailed Nov. 1, 2017, in U.S. Appl. No. 15/039,007, 12 pages.
Non final Office action mailed Nov. 14, 2019, in U.S. Appl. No. 14/765,814, Cook; D. et al., filed Aug. 4, 2015, 17 pages.
Non Final Office Action mailed Oct. 17, 2017, in U.S. Appl. No. 15/104,873, 6 pages.
Non Final Office Action mailed Oct. 22, 2019, in U.S. Appl. No. 15/742,732, Cook, D. et al., filed Jan. 8, 2018, 10 pages.
Non-Final Office Action mailed Dec. 9, 2019, in U.S. Appl. No. 16/223,008, Matthew R. Henn et al., filed Dec. 17, 2018, 17 pages.
Non-final Office Action mailed Jul. 22, 2014, in U.S. Appl. No. 14/221,190, Henn, M.R., et al., filed Mar. 20, 2014.
Non-final Office Action mailed Aug. 25, 2016, in U.S. Appl. No. 14/765,812, Afeyan, N.B., et al., filed Aug. 4, 2015.
Non-final Office Action mailed Mar. 25, 2014, in U.S. Appl. No. 14/091,201, Henn, M.R., et al., filed Nov. 26, 2013.
Non-final Office Action mailed Apr. 28, 2016, in U.S. Appl. No. 15/068,438, McKenzie, G., et al., filed Mar. 11, 2016.
Non-final Office Action mailed Aug. 17, 2016, in U.S. Appl. No. 14/884,655, McKenzie, G., et al., filed Oct. 15, 2015.
Non-Final Office action mailed Dec. 31, 2019, in U.S. Appl. No. 16/051,747, Maltzahn, G.V. et al., filed Aug. 1, 2018, 46 pages.
Non-Final Office Action mailed Mar. 10, 2020, in U.S. Appl. No. 15/778,095, Button, J. et al., filed May 22, 2018, 28 pages.
Non-final Office Action mailed May 5, 2016, in U.S. Appl. No. 14/884,655, McKenzie, G., et al., filed Oct. 15, 2015.
Non-Patent Literature Submitted with Notice of Opposition to a European Patent, Jul. 18, 2017, European Patent No. EP2575835: Other Evidence, E102635, 1 page.
Notice of Allowance mailed Jan. 13, 2020, in U.S. Appl. No. 15/986,369, Pamer; E. et al., filed May 22, 2018, 7 pages.
Nyangale, E.P., et al., "Gut Microbial Activity, Implications for Health and Disease: the Potential Role of Metabolite Analysis," Journal of Proteome Research, 11(12):5573-5585, American Chemical Society, United States (Dec. 2012).
Office Action mailed Dec. 10, 2014, in U.S. Appl. No. 14/313,828, McKenzie, G., et al., filed Jun. 24, 2014.
Office Action mailed Aug. 13, 2014, in U.S. Appl. No. 14/197,044, McKenzie, G., et al., filed Mar. 4, 2014.
Office Action mailed Aug. 13, 2014, in U.S. Appl. No. 14/313,828, McKenzie, G., et al., filed Jun. 24, 2014.
Office Action mailed May 15, 2015, in U.S. Appl. No. 14/313,828, McKenzie, G., et al., filed Jun. 24, 2014.
Office Action mailed Aug. 19, 2016, in U.S. Appl. No. 14/592,481, Henn, M.R., et al., filed Jan. 8, 2015.
Office Action mailed Dec. 22, 2015, in U.S. Appl. No. 14/592,481, Henn, M.R., et al., filed Jan. 8, 2015.
Office action mailed Dec. 21, 2018, in U.S. Appl. No. 15/986,369, Pamer; E. et al., filed May 22, 2018, 15 pages.
Office Action mailed Feb. 25, 2014, in European Patent Application No. 11728077.6 filed Jun. 3, 2011.
Office Action mailed Feb. 26, 2019, in U.S. Appl. No. 15/312,610, Pamer, E. et al., filed Nov. 18, 2016, 22 pages.
Office Action mailed Jul. 10, 2018, in U.S. Appl. No. 15/312,610, Pamer,E. et al., filed Nov. 18, 2016, 16 pages.
Office Action mailed Mar. 23, 2020, in U.S. Appl. No. 15/990,539, Henn, M. R., et al., filed May 25, 2018, 10 pages.
Office Action mailed Mar. 28, 2019, in U.S. Appl. No. 15/603,916, Van Den Brink; M., et al., filed May 24, 2017, 24 pages.
Office Action mailed May 14, 2019, in U.S. Appl. No. 15/603,916, Van Den Brink; M., et al., filed May 24, 2017, 25 pages.
Office Action mailed Nov. 13, 2019, in U.S. Appl. No. 15/603,916, Van Den Brink; M., et al., filed May 24, 2017, 21 pages.
Office action mailed Oct. 22, 2019, in U.S. Appl. No. 15/742,732, Cook; D. et al., filed Jan. 8, 2018, 10 pages.
Office Action mailed Oct. 29, 2019, in U.S. Appl. No. 15/990,539, Henn, M. R., et al., filed May 25, 2018, 25 pages.
Office Action mailed Sep. 18, 2015, in European Patent Application No. 11728077.6 filed Jun. 3, 2011.
Office action mailed Sep. 20, 2019, in U.S. Appl. No. 15/986,369, Pamer; E. et al., filed May 22, 2018, 10 pages.
O'Garra, A., et al., "IL-10-producing and Naturally Occurring CD4+ Tregs: Limiting Collateral Damage," The Journal of Clinical Investigation 114(10):1372-1378, American Society for Clinical Investigation, United states (Nov. 2004).
O'Hara, C.M., et al., "Classification, Identification, and Clinical Significance of Proteus, Providencia, and Morganella," Clinical Microbiology Reviews, 13(4):534-546, American Society for Microbiology, United States (Oct. 2000).
Okada, Y., et al., "Effects of Fecal Microorganisms and Their Chloroform-resistant Variants Derived From Mice, Rats, and Humans on Immunological and Physiological Characteristics of the Intestines of Ex-germfree Mice," Infection and Immunity, 62(12):5442-5446, American Society for Microbiology, United States (Dec. 1994).
Olle, B., "Medicines From Microbiota," Nature Biotechnology, 31(4):309-315, Nature America Publishing, United States (Apr. 2013).
Olszak, T., et al., "Microbial Exposure During Early Life Has Persistent Effects on Natural Killer T Cell Function," Science (New York, N.Y.), 336(6080):489-493, American Association for the Advancement of Science , United States, (Apr. 2012).
Oostdijk, E.A.N., et al., "Selective Decontamination in European Intensive Care Patients," Intensive Care Medicine 38(4): 533-538, Springer Verlag, United States (Apr. 2012).
Openbiome. Quality metrics. (http://static.squarespace.com/static/50e0c29ae4b0a05702af7e6a/t/52e19b89e4b0b28f802c9b4e/1390517129976/0penBiome%20Quality%20Metrics.pdf) Accessed Mar. 21, 2014.
Ott, S.J., et al., "Quantification of Intestinal Bacterial Populations by Real-time Pcr With a Universal Primer Set and Minor Groove Binder Probes: a Global Approach to the Enteric Flora," Journal of Clinical Microbiology, 42(6):2566-2572, American Society for Microbiology, United States, (Jun. 2004).
Out, C., et al., "Bile Acid Sequestrants: More Than Simple Resins," Current opinion in lipidology, 23(1):43-55, Lippincott Williams & Wilkins, England, (Feb. 2012).
Owens, C., et al., "Fecal Microbiota Transplantation and Donor Standardization," Trends In Microbiology, 21(9):443-445, Elsevier Trends Journals, England (Sep. 2013).
Paine, R.T., "A Note on Trophic Complexity and Community Stability," American Naturalist, 102(929):91-93, The University of Chicago Press for the American Society of Naturalists, United States (Jan.-Feb. 1969).
Palmfeldt, J., and Hahn-Hägerdal, B., "Influence of Culture pH on Survival of Lactobacillus Reuteri Subjected to Freeze-drying," International Journal of Food Microbiology, 55(1-3):235-238, Elsevier Science Publishers, Netherlands (Apr. 2000).
Pamer, E.G., "Fecal Microbiota Transplantation: Effectiveness, Complexities, and Lingering Concerns," Mucosal Immunology, 7(2):210-214, Nature Publishing Group, United States (Mar. 2014).
Papadimitriou, K. et al., "Discovering Probiotic Microorganisms: in Vitro, in Vivo, Genetic and Omics Approaches," Frontiers In Microbiology, 6:58, Frontiers Research Foundation, Switzerland (Feb. 2015).
Paredes-Sabja, D., et al., "Inorganic Phosphate and Sodium Ions Are Cogerminants for Spores of Clostridium perfringens Type A Food Poisoning-Related Isolates," Applied and Environmental Microbiology, 75(19):6299-6305, American Society for Microbiology, United States (Oct. 2009).
Parham et al., "A Receptor for the Heterodimeric Cytokine IL-23 is Composed of IL-12R~1 and a Novel Cytokine Receptor Subunit, IL-23R1," J Immunol 168:5699-5708—2002.
Park et al., "*Blautia faecis* sp. nov., isolated from human faeces," Int J Syst Evol Microbial. 63:599-603 (2013).
Partial Supplementary European Search Report dated Jan. 4, 2018 in Application No. 15796000.6.
Passweg et al., "Influence of protective isolation on outcome of allogeneic bone marrow transplantation for leukemia," Bone Marrow Transplantation 21:1231-1238 (1998).

(56) References Cited

OTHER PUBLICATIONS

Path Vaccine and Pharmaceutical Technologies Group. Summary of stability data for investigational formulations of vaccines. (http://www.path.org/publications/files/TS_vaccine_stability_table_invest.pdf) Accessed Mar. 21, 2014.
PCT Invitation to Pay Additional Fees, PCT Application No. PCT/US13/71758, mailed on Feb. 25, 2014, 4 pages.
PCT Invitation to Pay Additional Fees, PCT Application No. PCT/US14/14745, mailed on May 16, 2014, 2 pages.
PCT Invitation to Pay Additional Fees, PCT Application No. PCT/US14/29539, mailed on Jul. 31, 2014, 3 pages.
PCT Invitation to Pay Additional Fees, PCT Application No. PCT/US14/70684, mailed on Mar. 24, 2015, 2 pages.
PCT Invitation to Pay Additional Fees, PCT Application No. PCT/US2014/014738, mailed on May 16, 2014, 2 pages.
PCT Invitation to Pay Additional Fees, PCT Application No. PCT/US2014/030817, mailed on Sep. 8, 2014, 5 pages.
Peck, M.W. et al., "Development and Application of a New Method for Specific and Sensitive Enumeration of Spores of Nonproteolytic Clostridium Botulinum Types B, E, and F in Foods and Food Materials," Applied and Environmental Microbiology, 76(19):6607-6614, American Society for Microbiology, United States (Oct. 2010).
Pehkonen, K.S., et al., "State Transitions and Physicochemical Aspects of Cryoprotection and Stabilization in Freeze-drying of Lactobacillus Rhamnosus GG (LGG)," Journal of Applied Microbiology, 104(6):1732-1743, Society for Applied Bacteriology by Blackwell Science, England (Jun. 2008).
Pei, C.-X., et al., "Diversity and abundance of the bacterial 16S rRNA gene sequences in forestomach of alpacas (*Lama pacos*) and sheep (*Ovis aries*)," Anaerobe 16(4):426-432, Elsevier, Netherlands (published online Jun. 2010, published in print Aug. 2010).
Peighambardoust, S.H., et al., "Application of Spray Drying for Preservation of Lactic Acid Starter Cultures: a Review," Trends in Food Science & Technology, 22(5):215-224, Elsevier Ltd, Netherlands (May 2011).
Pelaseyed et al., "The mucus and mucins of the goblet cells and enterocytes provide the first defense line of the gastrointestinal tract and interact with the immune system," Immunological Reviews 260:8-20 (2014).
Pellegrino, P.M., et al., "Enhanced Spore Detection Using Dipicolinate Extraction Techniques," Analytica Chimica Acta, 455(2):167-177, Elsevier Ltd, Netherlands (Mar. 2002).
Peng, J., et al., "Update on Antimicrobial Resistance in Clostridium difficile: Resistance Mechanisms and Antimicrobial Susceptibility Testing," Journal of Clinical Microbiology 55(7): 1998-2008, American Society for Microbiology, United States (published online Apr. 2017, published in print Jul. 2017).
Perez, F., et al., "Effect of Antibiotic Treatment on Establishment and Elimination of Intestinal Colonization by Kpc-producing Klebsiella Pneumoniae in Mice," Antimicrobial Agents and Chemotherapy, 55(6):2585-2589, American Society for Microbiology, United States (Jun. 2011).
Perez, J., et al., "Clospore: a Liquid Medium for Producing High Titers of Semi-purified Spores of Clostridium Difficile," Journal of AOAC International, 94(2):618-626, AOAC International, United States (Mar.-Apr. 2011).
Petersen, F. B., et al., "Infectious Complications m Patients Undergoing Marrow Transplantation: A Prospective Randomized Study of the Additional Effect of Decontamination and Laminar Airflow Isolation among Patients Receiving Prophylactic Systemic Antibiotics," Scand J. Infect Dis. 19(5):559-567 (1987).
Peterson, D.A et al., "Metagenomic Approaches for Defining the Pathogenesis of Inflammatory Bowel Diseases," Cell Host & Microbe, 3(6):417-427, Cell Press, United States (Jun. 2008).
Petrof, E.O., et al., "Microbial Ecosystems Therapeutics: a New Paradigm in Medicine?," Beneficial Microbes, 4(1):53-65, Wageningen Academic Publishers, Netherlands (Mar. 2013).
Petrof, E.O., et al., "Stool Substitute Transplant Therapy for the Eradication of Clostridium Difficile Infection: 'Repoopulating' the Gut," Microbiome 1(1):3, BioMed Central, England (Jan. 2013).
Pharmacy, 2011, pp. 79-86, vol. 62, No. 3. [With English Main Sub-Points].
Picot, A., and Lacroix, C., "Encapsulation of Bifidobacteria in Whey Protein-based Microcapsules and Survival in Simulated Gastrointestinal Conditions and in Yoghurt," International Dairy Journal, 14(6):505-515, Elsevier Ltd, Netherlands (Jun. 2004).
Pillai, A. et al., "Probiotics for Treatment of Clostridium Difficile-Associated Colitis in Adults (Review)," Cochrane Database of Systematic Reviews, The Cochrane Collaboration, John Wiley & Sons, Ltd., 2010, 18 pages.
Pinn, D et al. (2013). Follow-up Study of Fecal Microbiota Transplantation (FMT) for the Treatment of Refractory Irritable Bowel Syndrome (IBS). Abstract ACG 2013.
Pittelkow, M.R. and Scott, R.E., "New Techniques for the in Vitro Culture of Human Skin Keratinocytes and Perspectives on Their Use for Grafting of Patients With Extensive Burns," Mayo Clinic Proceedings 61(10):771-777, Elsevier, England (Oct. 1986).
Plassart, C., et al., "First Case of Intra-abdominal Infection With Clostridium Disporicum," Anaerobe, 19:77-78, Academic Press, England (Feb. 2013).
Ponce et al., "Graft-versus-Host Disease after Double-Unit Cord Blood Transplantation Has Unique Features and an Association with Engrafting Unit-To-Recipient HLA Match," Biol. Blood Marrow Transplant 19:904-911 (2013).
Porada et al., "Treatment of Hemophilia A in Utero and Postnatally using Sheep as a Model for Cell and Gene Delivery," J. Genet Syndr Gene Ther., 25:Suppl. 1, 26 pages 2012).
Postgate, Jr., and Hunter, J.R., "On the Survival of Frozen Bacteria," Journal of General Microbiology, 26:367-378, Society for General Microbiology, England (Nov. 1961).
Potentials of Probiotics in Pig Nutrition, AIIAboutFeed News, Jan. 31, 2007, 6 pages.
Prilassnig, M. et al., "Are Probiotics Detectable in Human Feces After Oral Uptake by Healthy Volunteers?," Wiener Klinische Wochenschrift, 119(15-16):456-462, Springer, Austria (Aug. 2007).
Priority Document JP 2010-129134 for PCT Application No. PCT/JP2011/063302, Filed Jun. 4, 201 0, 42 pages.
Priority Document PCT/JP2010/071746 for PCT Application No. PCT/JP2011/063302, Filed Dec. 3, 2010, 107 pages.
Prioul T, G. et al., "Effect of Probiotic Bacteria on Induction and Maintenance of Oral Tolerance to β-Lactoglobulin in Gnotobiotic Mice," Clinical and Vaccine Immunology, 10(5):787-792, American Society for Microbiology, United States (Sep. 2003).
Pultz, N.J., et al., "Inhibition of Methicillin-resistant *Staphylococcus aureus* by an in Vitro Continuous-flow Culture Containing Human Stool Microflora," FEMS Microbiology Letters, 241(2):201-205, Oxford Oxford University Press, England (Dec. 2004).
Qiu, X., et al., "Faecalibacterium prausnitzii Upregulates Regulatory T Cells and Anti-Inflammatory Cytokines In Treating TNBS-Induced Colitis," Crohn's and Colitis 7(11):e558- e568, Elsevier Science, England (Dec. 2013 ).
Queenan, A.M., and Bush, K., "Carbapenemases: the Versatile Beta-lactamases," Clinical Microbiology Reviews, 20(3):440-458, American Society for Microbiology, United States (Jul. 2007).
Quigley, E.M., and Quera, R., "Small Intestinal Bacterial Overgrowth: Roles of Antibiotics, Prebiotics, and Probiotics," Gastroenterology, 130(2 Suppl 1):S78-S90, W.B. Saunders, United States (Feb. 2006).
Raibaud, P., et al., "Implantation of Bacteria From the Digestive Tract of Man and Various Animals Into Gnotobiotic Mice," The American Journal of Clinical Nutrition, 33(11 Suppl):2440-2447, American Society of Clinical Nutrition, United States (Nov. 1980).
Rakoff-Nahoum, S., et al., "Recognition of Commensal Microflora by Toll-like Receptors is Required for Intestinal Homeostasis," Cell, 118(2):229-241, Cell Press, United States, (Jul. 2004).
Ramirez, N., and Abel-Santos, E., "Requirements for Germination of Clostridium sordellii Spores In Vitro," Journal of Bacteriology, 192(2):418-425, American Society for Microbiology, United States (Jan. 2010).

(56) References Cited

OTHER PUBLICATIONS

Rao, A.V., et al., "Survival of Microencapsulated Bifidobacterium Pseudolongum in Simulated Gastric and Intestinal Juices," Canadian Institute of Food Science and Technology Journal, 22(4):345-349, Elsevier Ltd, Netherlands (Oct. 1989).
Rasti et al., "Inhibition of Clostridium scindens and Clostridium hiranonis growth by Bifidobacterium pseudocatenulatum G4 in simulated colonic pH," Journal of Food Agriculture and Environment 11 (2): 127-131, WFL Publisher Ltd, Poland (2013).
Rea, M.C., et al., "Effect of Broad- and Narrow-spectrum Antimicrobials on Clostridium Difficile and Microbial Diversity in a Model of the Distal Colon," Proceedings of the National Academy of Sciences of the United States of America, 108 Suppl 1:4639-4644, National Academy of Sciences, United States, ( Mar. 2011 ).
Rea, M.C., et al., "Thuricin Cd, a Posttranslationally Modified Bacteriocin With a Narrow Spectrum of Activity Against Clostridium Difficile," Proceedings of the National Academy of Sciences of the United States of America, 107(20):9352-9357, National Academy of Sciences, (May 2010).
Reeves, A.E., et al., "Suppression of Clostridium Difficile in the Gastrointestinal Tracts of Germfree Mice Inoculated With a Murine Isolate From the Family Lachnospiraceae," Infection and Immunity, 80(11):3786-3794, American Society for Microbiology, United States (Nov. 2012).
Reeves, A.E., et al., "The Interplay Between Microbiome Dynamics and Pathogen Dynamics in a Murine Model of Clostridium Difficile Infection.," Gut Microbes, 2(3):145-158, Philadelphia, PA : Taylor & Francis, (May 2011).
Rehman, A. et al., "Effects of Probiotics and Antibiotics on the Intestinal Homeostasis in a Computer Controlled Model of the Large Intestine," BMC Microbiology, 12:47, BioMed Central, England (Mar. 2012).
Response of Jan. 28, 2015 in Examination, European Application No. 11728077.6, 3 pages.
Response to Official Communication mailed on Sep. 18, 2018, European Application No. 11728077.6, filed Nov. 18, 2015 , 2 pages.
Rexroad, J., et al., "Lyophilization and the Thermostability of Vaccines," Cell Preservation Technology, 1(2):91-104, Mary Ann Liebert, Inc, United States (Jun. 2002).
Rheinwald, J.G., "Chapter 15 Serial Cultivation of Normal Human Epidermal Keratinocytes," Methods in Cell Biology 21A:229-254, Academic Press, United States (1980).
Ridaura, V.K., et al., "Gut Microbiota From Twins Discordant for Obesity Modulate Adiposity and Metabolic Phenotypes in Mice," Science, 341(6150):1241214, American Association for the Advancement of Science, United States (Sep. 2013).
Ridlon, J.M and Hylemon, P.B., "Identification and Characterization of Two Bile Acid Coenzyme a Transferases From Clostridium Scindens, a Bile Acid 7α-dehydroxylating Intestinal Bacterium.," Journal of Lipid Research, 53(1):66-76, American Society for Biochemistry and Molecular Biology, United States, (Jan. 2012).
Ridlon, J.M., "Enzymology and Molecular Biology of Bile Acid 7alpha- and 7beta-Dehydroxylation by the Intestinal Bacteria Clostridium Scindens and Clostridium Hylemonae," VCU Theses and Dissertations, Paper 736 (2008).
Ridlon, J.M.,et al., "Clostridium Scindens: a Human Gut Microbe With a High Potential to Convert Glucocorticoids Into Androgens.," Journal of Lipid Research, 54(9):2437-2449, American Society for Biochemistry and Molecular Biology, United States, (Sep. 2013).
Ridlon,J.M,.et al, "Bile Salt Biotransformations by Human Intestinal Bacteria.," Journal of Lipid Research, 47(2):241-259, American Society for Biochemistry and Molecular Biology, (Feb. 2006).
Roberts, B., "Generation and Development of Defined Microbial Drug Products," Vedanta Biosciences, 17 pages (2016).
Robinson, I.M. et al., "Emendation of Acetivibrio and Description of Acetivibrio Ethanolgignens, a New Species From the Colons of Pigs With Dysentery," International Journal of Systematic Bacteriology , 31(3):333-338 (Jul. 1981).
Rode, L.J., and Foster, J.W., "Germination of Bacterial Spores With Alkyl Primary Amines1," Journal of Bacteriology, 81(5):768-779, American Society for Microbiology, United States (May 1961).
Roffe, C., "Biotherapy for Antibiotic-associated and Other Diarrhoeas," The Journal of infection, 32(1):1-10, W.B. Saunders, England (Jan. 1996).
Rohleke, F., et al., "Fecal Flora Reconstitution for Recurrent Clostridium Difficile Infection: Results and Methodology," Journal of Clinical Gastroenterology, 44(8):567-570, Wolters Kluwer Health, Inc, United States (Sep. 2010).
Rosen, D.L., et al., "Bacterial Spore Detection and Determination by Use of Terbium Dipicolinate Photoluminescence," Analytical Chemistry, 69(6):1082-1085, American Chemical Society, United States (1997).
Rosero, J.A., et al., "Reclassification of Eubacterium Rectale (Hauduroy Et Al. 1937) Prévot 1938 in a New Genus *Agathobacter* Gen. Nov. as Agathobacter Rectalis Comb. Nov., and Description of *Agathobacter ruminis* Sp. Nov., Isolated From the Rumen Contents of Sheep and Cows," International Journal of Systematic and Evolutionary Microbiology, 66(2):768-773, Microbiology Society, England (Feb. 2016).
Rossen, N.G., et al., "Findings From a Randomized Controlled Trial of Fecal Transplantation for Patients With Ulcerative Colitis.," Gastroenterology, 149(1):110-118, W.B. Saunders, United States (Jul. 2015).
Rossi, O., et al., "Faecalibacterium Prausnitzii A2-165 has a High Capacity to Induce IL-10 in Human and Murine Dendritic Cells and Modulates T Cell Responses," Scientific Reports 6:12 pages, (Jan. 2015).
Rowlings, P. A., et al., "IBMTR Severity Index for grading acute graft-versus-host disease: retrospective comparison with Glucksberg grade," Br J Haematol. 97:855-864 (1997).
Rupnik, M.,et al., "Clostridium Difficile Infection: New Developments in Epidemiology and Pathogenesis.," Nature Reviews. Microbiology, 7(7):526-536, Nature Pub. Group, c2003—,England, (Jul. 2009).
Russell, A.D., "The Destruction of Bacterial Spores," 1982, pp. 191-193.
Russell et al., "Early Outcomes After Allogeneic Stem Cell Transplantation for Leukemia and Myelodysplasia Without Protective Isolation: A 1 0-year Experience," Biol. Blood Marrow Transplant 6(2): 109-114 (2000).
Russian First Office Action, Russian Patent Application No. 2015124366, Dec. 13, 2016, 12 pages.
Russian First Office Action, Russian Patent Application No. 2015137399, issued Aug. 15, 2016, 8 pages.
Russian Office Action, Russian Application No. 2015137399, Mar. 22, 2016, 8 pages.
Russian Second Office Action, Russian Application No. 2015124366, Feb. 12, 2018, 10 pages.
Russian Second Office Action, Russian Patent Application No. 2015137399, Mar. 14, 2017, 8 pages.
Sack, D.A., et al., "Comparison of Alternative Buffers for Use With a New Live Oral Cholera Vaccine, Peru-15, in Outpatient Volunteers," Infection and Immunity, 65(6):2107-2111, American Society for Microbiology, United States (Jun. 1997).
Sacks, L.E. and Alderton, G., "Behavior of Bacterial Spores in Aqueous Polymer Two-phase Systems," Journal of Bacteriology, 82(3):331-341, American Society for Microbiology, United States (Sep. 1961).
Sahlstrom, L., et al., "A Laboratory Study of Survival of Selected Microorganisms After Heat Treatment of Biowaste Used in Biogas Plants," Bioresource Technology, 99(16):7859-7865, Elsevier Science Pub. Co., England (Nov. 2008).
Sakamoto et al., "Eubacterium limosum strain JCM 6421 16S ribosomal RNA gene, partial sequence" NCBI Reference Sequence NR_113248.1, Nov. 23, 2016, accessed at URL:[https://www.ncbi.nlm.nih.gov/nuccore/631252050] on Jul. 17, 2019, 2 pages.
Salzman et al., "Analysis of 16S libraries of mouse gastrointestinal microflora reveals a large new group of mouse intestinal bacteria," Microbiology 148:3651-3660 (2002).
Sanchez, A.M. and Yang, Y., "The Role of Natural Regulatory T Cells in Infection," Immunologic Research 49(1-3):124-134, Humana Press, United states (Apr. 2011 ).

(56) References Cited

OTHER PUBLICATIONS

Santivarangkna, C., et al., "Alternative Drying Processes for the Industrial Preservation of Lactic Acid Starter Cultures," Biotechnology Progress, 23(2):302-315, Wiley-Blackwell, United States (Mar.-Apr. 2007).
Sartor, R.B., "Therapeutic Correction of Bacterial Dysbiosis Discovered by Molecular Techniques," Proceedings of the National Academy of Sciences of the United States of America 105(43):16413-16414, National Academy of Sciences, United states (Oct. 2008).
Sattar, S.A., et al., "Foodborne Spread of Hepatitis a: Recent Studies on Virus Survival, Transfer and Inactivation," The Canadian Journal of Infectious Diseases, 11(3):159-163, Pulsus Group, Inc., Canada (May-Jun. 2000).
Savaiano, D.A., et al., "1040 A Novel High Purity Short-Chain Galacto-Oligosaccharide (RP-G28) Improves Lactose Digestion and Symptoms of Lactose Intolerance," Gastroenterology, 142(5 Supp 1):S-182, Elsevier Inc, Netherlands (May 2012).
Savaiano, D.A., et al., "Improving Lactose Digestion and Symptoms of Lactose Intolerance With a Novel Galacto-oligosaccharide (Rp-g28): a Randomized, Double-blind Clinical Trial," Nutrition Journal, 12:160, BioMed Central, England (Dec. 2013).
Schjørring, S and Krogfelt, K.A., "Assessment of Bacterial Antibiotic Resistance Transfer in the Gut," International Journal of Microbiology 2011:312956, Hindawi Publishing, Egypt (2011).
Schloss, P.D., et al., "Introducing Mothur: Open-source, Platform-independent, Community-supported Software for Describing and Comparing Microbial Communities," Applied and Environmental Microbiology 75(23):7537-7541, American Society for Microbiology, United States (Dec. 2009).
Schloss, P.D., et al., "Reducing the Effects of Pcr Amplification and Sequencing Artifacts on 16s Rrna-based Studies," PLoS One 6(12):e27310, Public Library of Science, United States (Dec. 2011).
Schoefer, L., et al., "Anaerobic degradation of flavonoids by Clostridium orbiscindens," Appl Environ Microbiol 69(10):5849-5854, American Society of Microbiology, United States (Oct. 2003).
Schwab et al., "Neutrophil granulocytes recruited upon translocation of intestinal bacteria enhance graft-versus-host disease via tissue damage," Nature Medicine 20(6):648-654—2014.
Seale, R.B., et al., "Recovery of Spores From Thermophilic Dairy Bacilli and Effects of Their Surface Characteristics on Attachment to Different Surfaces," Applied and Environmental Microbiology, 74(3):731-737, American Society for Microbiology, United States (Feb. 2008).
Segata et al., "Metagenomic biomarker discovery and explanation," Genome Biol. 12:R60—2011.
Seguy et al., "Enteral Feeding and Early Outcomes of Patients Undergoing Allogeneic Stem Cell Transplantation following Myeloablative Conditioning," Transplantation 82:835-839 (2006).
Seki, H., et al., "Prevention of Antibiotic-Associated Diarrhea in Children by Clostridium Butyricum MIYAIRI," Pediatrics International, 45(1):86-90, Blackwell Science Asia, Australia (Feb. 2003).
Seo, M., et al., "Clostridium Butyricum Miyairi 588 Improves High-fat Diet-induced Non-alcoholic Fatty Liver Disease in Rats," Digestive Diseases and Sciences, 58(12):3534-3544, Springer Science+ Business Media, United States (Dec. 2013).
Sequence Listing, PCT Application No. PCT/JP2011/063302, 43 pages, Dec. 8, 2011.
Setlow, B., et al., "Analysis of the Germination Kinetics of Individual Bacillus Subtilis Spores Treated With Hydrogen Peroxide or Sodium Hypochlorite," Letters in Applied Microbiology, 57(4):259-265, Published for the Society for Applied Bacteriology by Blackwell Scientific Publications, England (Oct. 2013).
Setlow, B., et al., "Germination of Spores of Bacillus Subtilis With Dodecylamine," Journal of Applied Microbiology, 95(3):637-648, Oxford : Published for the Society for Applied Bacteriology by Blackwell Science, England (2003).
Setlow, B., et al., "Mechanisms of Killing Spores of Bacillus Subtilis by Acid, Alkali and Ethanol," Journal of Applied Microbiology, 92(2):362-375, Published for the Society for Applied Bacteriology by Blackwell Science, England (2002).
Sghir, A., et al., "Quantification of Bacterial Groups Within Human Fecal Flora by Oligonucleotide Probe Hybridization," Applied and Environmental Microbiology 66(5):2263-2266, American Society for Microbiology, United States (May 2000).
Shafaat, H.S., and Ponce, A., "Applications of a Rapid Endospore Viability Assay for Monitoring UV Inactivation and Characterizing Arctic Ice Cores," Applied and Environmental Microbiology, 72(10):6808-6814, American Society for Microbiology, United States (Oct. 2006).
Shah, I.M., et al., "A Eukaryotic-like Ser/Thr Kinase Signals Bacteria to Exit Dormancy in Response to Peptidoglycan Fragments," Cell, 135(3):486-496, Cell Press, United States (Oct. 2008).
Shah, N.P. et al., "Microencapsulation of Probiotic Bacteria and Their Survival in Frozen Fermented Dairy Desserts," The Australian Journal of Dairy Technology, Oct. 2000, pp. 139-144, vol. 55, No. 3.
Shah, N.P., "Symposium: Probiotic Bacteria: Probiotic Bacteria: Selective Enumeration and Survival in Dairy Foods," Oct. 7, 1999, 14 pages.
Shah, S. (2012). Clostridium difficile in inflammatory Bowel Disease: a dangerous mix (Clostridium difficile Symposium, Miriam Hospital, Providence, RI).
Shahinas, D., et al., "Toward an Understanding of Changes in Diversity Associated With Fecal Microbiome Transplantation Based on 16S rRNA Gene Deep Sequencing," 3(5):e00338-12, American Society for Microbiology, United States (Oct. 2012).
Shannon, "The Mathematical Theory of Communication," M.D. Computing 14( 4): 3 06-317 (1997).
Sharpe, E.S. et al., "Separation of Spores and Parasporal Crystals of Bacillus Thuringiensis in Gradients of Certain X-ray Contrasting Agents," Applied Microbiology, 30(6):1052-1053, American Society for Microbiology, United States (Dec. 1975).
Sheneman, L.,et al., "Clearcut: a Fast Implementation of Relaxed Neighbor Joining.," Bioinformatics (Oxford, England), 22(22):2823-2824, Oxford University Press, c1998,England, (Nov. 2006).
Sheptulin, A.A., "Refractory and Relapsing Forms of Clostridium difficile-Associated Colitis," www.gastro-j.ru, 2011, pp. 50-53 (with English abstract).
Sheu, T.Y., et al., "Improving Survival of Culture Bacteria in Frozen Desserts by Microentrapment," Journal of Dairy Science, 76(7):1902-1907, American Dairy Science Association, United States (Jul. 1993).
Shono et al., "A Small-Molecule c-Rel Inhibitor Reduces Alloactivation of T Cells without Compromising Antitumor Activity," Cancer Discovery 4(5):578-591 (2014).
Siaterlis, A., et al., "Effect of Culture Medium and Cryoprotectants on the Growth and Survival of Probiotic Lactobacilli During Freeze Drying," Letters in Applied Microbiology, 48(3):295-301, Published for the Society for Applied Bacteriology by Blackwell Scientific Publications, England (Mar. 2009).
Sigma-Tau. VSL#3. http://www.vsl3.com/; Accessed Mar. 21, 2014.
Silvestri, L and Van Saene, H.K.F., "Selective Decontamination of the Digestive Tract : An Update of the Evidence," HSR Proceedings in Intensive Care & Cardiovascular Anesthesia 4(1): 21-29, Edizioni medico scientifiche, Italy (2012).
Sinal, C.J., et al., "Targeted disruption of the nuclear receptor FXR/BAR impairs bile acid and lipid homeostasis," Cell 102(6):731-744, Cell Press, United States (Sep. 2000).
Skaar, E., "The Battle for Iron between Bacterial Pathogens and Their Vertebrate Hosts," PLoS Pathogens, 6(8):e1000949, Public Library of Science, United States (Aug. 2010).
Sleator, R.D., Hill, C., "Designer Probiotics: a Potential Therapeutic for Clostridium Difficile?," Journal of Medical Microbiology, 57(Pt 6):793-794, Microbiology Society, England (Jun. 2008).
Smit, J.J., et al., "Homozygous Disruption of the Murine Mdr2 P-Glycoprotein Gene Leads to a Complete Absence of Phospholipid from Bile and to Liver Disease," Cell 75(3):451-462, Cell Press, United States (Nov. 1993).
Smith, P.M., et al., "The Microbial Metabolites, Short-Chain Fatty Acids, Regulate Colonic Treg Cell Homeostasis," Science 341(6145):569-573, American Association for the Advancement of Science, United States (Aug. 2013 ).

(56) References Cited

OTHER PUBLICATIONS

Snitkin, E.S., et al., “Tracking a Hospital Outbreak of Carbapenem-resistant Klebsiella Pneumoniae With Whole-genome Sequencing,” Science Translational Medicine, 4(148):148ral16, American Association for the Advancement of Science, United States (Aug. 2012).

Sokol, H., et al., “Faecalibacterium Prausnitzii Is an Anti-Inflammatory Commensal Bacterium Identified by Gut Microbiota Analysis of Crohn Disease Patients, ” Proceedings of the National Academy of Sciences 105(43):16731-16736, National Academy of Sciences, United States (Oct. 2008).

Sokol, H., et al., “Low Counts of Faecalibacterium Prausnitzii in Colitis Microbiota,” Inflammatory Bowel Diseases 15(8):1183-1189, Lippincott Williams & Wilkins, nited States (Aug. 2009).

Solanki, H.K., et al., “Development of Microencapsulation Delivery System for Long-term Preservation of Probiotics as Biotherapeutics Agent,” BioMed Research International, 2013:620719, Hindawi Pub. Co., United States (2013).

Solomkin et al., “Diagnosis and Management of Complicated Intra-abdominal Infection in Adults and Children: Guidelines by the Surgical Infection Society and the Infectious Diseases Society of America,” Clin Infect Dis. 50:133-164 (2010).

Song P., et al., “Individual Bile Acids Have Differential Effects on Bile Acid Signaling in Mice,” Toxicology and applied pharmacology 283(1):57-64, Academic Press, New York (Feb. 2015).

Song, Y., et al., “*Clostridium bolteae* sp. nov., isolated from human sources,” Syst Appl Microbiol 26(1):84-89, Elsevier, Netherlands (Mar. 2003).

Song, Y., et al., “Clostridium boltei partial 16S rRNA gene, strain 16351” Database NCBI Nucleotide [online] accession No. AJ508452, Apr. 18, 003, [retrieved on Dec. 22, 2020], retrieved from the internet: <url: <a= href=>https://www.ncbi.nlm.nih.gov/nuccore/AJ508452, 2 pages .</url:>.

SOP No. MB-28-00. http://www.epa.gov/pesticides/methods/MB-28-00.pdf; Accessed Mar. 27, 2014.

Sorg, J.A., and Sonenshein, A.L., “Bile Salts and Glycine as Cogerminants for Clostridium Difficile Spores,” Journal of Bacteriology, 190(7):2505-2512, American Society for Microbiology, United States (Apr. 2008).

Sorg, J.A and Sonenshein, A.L., “Chenodeoxycholate is an Inhibitor of Clostridium Difficile Spore Germination.,” Journal of Bacteriology, 191(3):1115-1117, American Society for Microbiology, United States, (Feb. 2009).

Sow, H., et al., “Heat Inactivation of Hepatitis a Virus and a Norovirus Surrogate in Soft-shell Clams (*Mya arenaria*),” Foodborne Pathogens and Disease, 8(3):387-393, Mary Ann Liebert, Inc., United States (Mar. 2011).

Spinler, J. K., et al., “Probiotics as adjunctive therapy for preventing Clostridium difficile infection—What are we waiting for?,” Anaerobe 41:51-57, Elsevier, Netherlands (Oct. 2016).

Stackebrandt, E., et al., “Taxonomic Note: A Place for DNA-DNA Reassociation and 16s rRNA Sequence Analysis in the Present Species Definition in Bacteriology ,” International Journal of Systematic Bacteriology 44 (4):846-849, (Oct. 1994).

Stams, A.J.M., et al., “Growth of Syntrophic Propionate-Oxidizing Bacteria with Fumarate in the Absence of Methanogenic Bacteria,” Applied and Environmental Microbiology, 59(4):1114-1119, American Society for Microbiology, United States (Apr. 1993).

Stefka, A.T., et al., “Commensal Bacteria Protect Against Food Allergen Sensitization,” Proceedings of the National Academy of Sciences of the United States of America, 111(36):13145-13150, National Academy of Sciences, United States (Sep. 2014).

Stein, R.R.,et al., “Ecological Modeling From Time-series Inference: Insight Into Dynamics and Stability of Intestinal Microbiota.,” Plos Computational Biology, 9(12):1003388, Public Library of Science, [2005], United States , (Sep. 2013).

Stemple, D.L. and Anderson, D.J., “Isolation of a Stem Cell for Neurons and Glia From the Mammalian Neural Crest,” Cell 71(6):973-985, Cell Press, United States (Dec. 1992).

Stevens, K.A., and Jaykus, L.A., “Bacterial Separation and Concentration From Complex Sample Matrices: a Review,” Critical Reviews in Microbiology, 30(1):7-24, Informa Healthcare, England (2004).

Storb et al., “Graft-Versus-Host Disease and Survival in Patients with Aplastic Anemia Treated by Marrow Grafts from HLA-Identical Siblings. Beneficial Effect of a Protective Environment,” N Engl J Med. 308:302-307 (1983).

Su, W.J., et al., “Role of Volatile Fatty Acids in Colonization Resistance to Clostridium Difficile in Gnotobiotic Mice,” Infection and Immunity, 55(7):1686-1691, American Society for Microbiology, United States (Jul. 1987).

Sudarsanam, P., et al., “[Clostridium] Bolteae ATCC BAA-613 C_bolteae-3.0.1_Cont299, Whole Genome Shotgun Sequence,” Database NCBI Nucleotide [online] accession No. ABCC02000039, Jan. 14, 2008, [retrieved on Dec. 22, 2020], retrieved from the internet: <url: <a=“” href=“https://www.ncbi.nlm.nih.gov/nuccore/ABCC02000039.1/”>https://www.ncbi.nlm.nih.gov/ nuccore/ABCC02000039.1/, 99 pages .</url:>.

Supplementary Partial European Search Report dated Jun. 14, 2018 in Application No. EP 15862844.

Surawicz, C.M and Alexander, J., “Treatment of Refractory and Recurrent Clostridium Difficile Infection,” Nature Reviews Gastroenterology & Hepatology, 8(6):330-339, Nature Publishing Group, England (Jun. 2011).

Swidsinski et al., “Spatial Organization and Composition of the Mucosal Flora in Patients with Inflammatory Bowel Disease,” Journal of Clinical Microbiology 43(7):3380-3389—2005.

Takaishi, H., et al., “Imbalance in Intestinal Microflora Constitution Could Be Involved In the Pathogenesis of Inflammatory Bowel Disease,” International Journal of Medical Microbiology 298(5-6):463-572, Urban & Fischer Verlag, Germany (Jul. 2008 ).

Talwalkar, A., and Kailasapathy, K., “Effect of Microencapsulation on Oxygen Toxicity in Probiotic Bacteria,” Australian Journal of Dairy Technology, 58(1):36-39, Australian Society of Dairy Technology, Australia (2003).

Tamir, H., and Gilvarg, C., “Density Gradient Centrifugation for the Separation of Sporulating Forms of Bacteria,” The Journal of Biological Chemistry, 241(5):1085-1090, American Society for Biochemistry and Molecular Biology, United States (Mar. 1966).

Tanaka, M et al., “Increased Fasting Plasma Ghrelin Levels in Patients With Bulimia Nervosa,” European Journal of Endocrinology, 146(6):R1-3, BioScientifica Ltd, England (Jun. 2002).

Taur et al., “The effects of intestinal tract bacterial diversity on mortality following allogeneic hematopoietic stem cell transplantation,” Blood 124(7): 1174-1182 (2014).

Taur, Y., and Pamer, E.G., “Harnessing Microbiota to Kill a Pathogen: Fixing the Microbiota to Treat Clostridium Difficile Infections,” Nature Medicine, 20(3):246-247, Nature Publishing Company, United States (Mar. 2014).

Taur, Y., et al., “Intestinal Domination and the Risk of Bacteremia in Patients Undergoing Allogeneic Hematopoietic Stem Cell Transplantation,” Clinical Infectious Diseases : an Official Publication of the Infectious Diseases Society of America, 55(7):905-914, Oxford University Press, United States (Oct. 2012).

Technical Data, HiMedia Laboratories Pvt. Ltd., M581 BP, 2011, pp. 1-2.

Theriot, C.M. et al., “Antibiotic-induced Shifts in the Mouse Gut Microbiome and Metabolome Increase Susceptibility to Clostridium Difficile Infection,” Nature Communications, 5:3114, Nature Publishing Group, England (Jan. 2014).

Thomas, C., et al., “Targeting Bile-acid Signalling for Metabolic Diseases,” Nature Reviews. Drug Discovery 7(8):678-693, Nature Pub. Group, England (Aug. 2008).

Thompson-Chagoyan, O.C., et al., “Aetiology of Inflammatory Bowel Disease (IBD): Role of Intestinal Microbiota and Gut-associated Lymphoid Tissue Immune Response,” Clinical Nutrition, 24(3):339-352, Elsevier,England (Feb. 2005).

Tisa, L.S., et al., “Wet and Dry Bacterial Spore Densities Determined by Buoyant Sedimentation,” Applied and Environmental Microbiology, 43(6):1307-1310, American Society for Microbiology, United States (Jun. 1982).

(56) References Cited

OTHER PUBLICATIONS

Tolstoshev, P., "Gene Therapy, Concepts, Current Trials and Future Directions," Annual Review of Pharmacology and Toxicology 33:573-596, Annual Reviews, United States (1993).
Turnbaugh, P.J.,et al., "A Core Gut Microbiome in Obese and Lean Twins.," Nature, 457(7228):480-484, Nature Publishing Group, England, (Jan. 2009).
Tvede, M, and Rask-Madsen, J., "Bacteriotherapy for Chronic Relapsing Clostridium Difficile Diarrhoea in Six Patients," Lancet 1(8648):1156-1160, Elsevier, England (May 1989).
Ubeda, C., et al., "Intestinal Microbiota Containing *Barnesiella* Species Cures Vancomycin-resistant Enterococcus Faecium Colonization," Infection and Immunity, 81(3):965-973, American Society for Microbiology, United States (Mar. 2013).
Ubeda, C., et al., "Vancomycin-resistant Enterococcus Domination of Intestinal Microbiota Is Enabled by Antibiotic Treatment in Mice and Precedes Bloodstream Invasion in Humans," The Journal of Clinical Investigation, 120(12):4332-4341, American Society for Clinical Investigation, United States (Dec. 2010).
Van Der Woude, M.W., and Baumler, A.J., "Phase and Antigenic Variation in Bacteria," Clinical Microbiology Reviews, 17(3):581-611, American Society for Microbiology, United States (Jul. 2004).
Van Immerseel, F., et al., "Butyric Acid-Producing Anaerobic Bacteria as a Novel Probiotic Treatment Approach for Inflammatory Bowel Disease," Medical Microbiology 59(Pt 2):141-143, Microbiology Society, England (Feb. 2010).
Van Kregten, E., et al., "New, Simple Medium for Selective Recovery of Klebsiella Pneumoniae and Klebsiella Oxytoca From Human Feces," The Journal of Clinical Microbiology, 20(5):936-941, American Society for Microbiology, United States (Nov. 1984).
Van Nood, E., et al., "Duodenal Infusion of Donor Feces for Recurrent Clostridium Difficile," The New England Journal of Medicine 368(5):407-415, Massachusetts Medical Society, United States (Jan. 2013).
Vandenplas, Y. et al., "Fecal Microbial Transplantation in Early-onset Colitis: Caution Advised," Journal of Pediatric Gastroenterology and Nutrition, 61(3):e12-4, Lippincott Williams & Wilkins, United States (Sep. 2015).
Vidal, M., et al., "Probiotics and Intestinal Colonization by Vancomycin-resistant Enterococci in Mice and Humans," The Journal of Clinical Microbiology, 48(7):2595-2598, American Society for Microbiology, United States (Jul. 2010).
Vigorito et al., "Evaluation of NIH consensus criteria for classification of late acute and chronic GVHD," Blood 114(3):702-708 (2009).
Villano, S.A., et al., "Evaluation of an Oral Suspension of VP20621, Spores of Nontoxigenic Clostridium Difficile Strain M3, in Healthy Subjects," Antimicrobial Agents and Chemotherapy, 56(10):5224-5229, American Society for Microbiology, United States (Oct. 2012).
Vogt et al. "Chemical communication in the gut: Effects of microbiota-generated metabolites on gastrointestinal bacterial pathogens," Anaerobe 34 106-115, Elsevier, Netherlands (2015).
Vossen et al., "Complete Suppression of the Gut Microbiome Prevents Acute Graft-Versus Host Disease following Allogeneic Bone Marrow Transplantation," PLoS ONE 9(9):el05706 (2014).
Wachsman, J.T., et al., "Characterization of an Orotic Acid Fermenting Bacterium, Zymobacterium Oroticum, Nov. Gen., Nov. Spec," Bacteriology 68(4):400-404, American Society for Microbiology, United States (Oct. 1954).
Wagman, J., and Weneck, E.J., "Preservation of Bacteria by Circulating-gas Freeze Drying," Applied Microbiology, 11:244-248, American Society for Microbiology, United States (May 1963).
Waites, W.M., and Wyatt, L.R., "Germination of Spores of Clostridium Bifermentans by Certain Amino Acids, Lactate and Pyruvate in the Presence of Sodium or Potassium Ions," Journal of General Microbiology, 67(2):215-222, Society for General Microbiology, England (Aug. 1971).
Waites, W.M., and Wyatt, L.R., "The Effect of pH, Germinants and Temperature on the Germination of Spores of Clostridium Bifermentans," Journal of General Microbiology, 80(1):253-258, Society for General Microbiology, England (Jan. 1974).
Walker, A.W., and Lawley, T.D., "Therapeutic Modulation of Intestinal Dysbiosis," Pharmacological Research, 69(1):75-86, Elsevier, Netherlands (Mar. 2013).
Wang, M., et al., "Comparison of Bacterial Diversity Along the Human Intestinal Tract by Direct Cloning and Sequencing of 16S rRNA Genes," FEMS Microbiology Ecology, 54(2):219-231, Oxford University Press, England (Oct. 2005).
Wang, Q., et al., "Naive Bayesian Classifier for Rapid Assignment of Rrna Sequences Into the New Bacterial Taxonomy," Applied and Environmental Microbiology 73(16):5261-5267, American Society for Microbiology, United States (Aug. 2007).
Wang, S., and Curtiss III, R., "Development of Streptococcus Pneumoniae Vaccines Using Live Vectors," Vaccines, 2(1):49-88, MDPI AG, Switzerland (Jan. 2014).
Warren, Y.A., et al., "*Clostridium aldenense* Sp. Nov. and *Clostridium citroniae* Sp. Nov. Isolated from human clinical Infections," Journal of Clinical Microbiology 44(7):2416-2422, American Society for Microbiology, United States (Jul. 2006 ).
Weber et al., "Low urinary indoxyl sulfate levels early after transplantation reflect a disrupted microbiome and are associated with poor outcome," Blood 126(14): 1723-1728 -2015.
Weingarden, A.R., et al., "Microbiota Transplantation Restores Normal Fecal Bile Acid Composition in Recurrent Clostridium Difficile Infection," American Journal of Physiology. Gastrointestinal and Liver Physiology, 306(4):G310-319, American Physiological Society, United States (Feb. 2014).
Wells, C.L. et al., Chapter 18: Clostridia: Sporeforming Anaerobic Bacilli, Medical Microbiology, 4th Edition, 1996, pp. 1-20.
Wells, J.E and Hylemon, P.B., "Identification and Characterization of a Bile Acid 7alpha-dehydroxylation Operon in *Clostridium* Sp. Strain to-931, a Highly Active 7alpha-dehydroxylating Strain Isolated From Human Feces.," Applied and Environmental Microbiology, 66(3):1107-1113, American Society for Microbiology, United States, (Mar. 2000).
Wells, J.E.,et al., "Development and Application of a Polymerase Chain Reaction Assay for the Detection and Enumeration of Bile Acid 7alpha-dehydroxylating Bacteria in Human Feces.," Clinica chimica acta; international journal of clinical chemistry, 331(1-2):127-134, Elsevier, Netherlands, (May 2003).
Wiencek, K.M et al., "Hydrophobicity of Bacillus and Clostridium Spores," Applied and Environmental Microbiology, 56(9):2600-2605, American Society for Microbiology, United States (Sep. 1990).
Wilson, K.H and Freter, R, "Interaction of Clostridium Difficile and *Escherichia coli* With Microfloras in Continuous-flow Cultures and Gnotobiotic Mice," Infection and Immunity, 54(2):354-358, American Society for Microbiology, United States (Nov. 1986).
Wilson, K.H., et al., "Role of Competition for Nutrients in Suppression of Clostridium Difficile by the Colonic Microflora," Infection and Immunity, 56(10):2610-2614, American Society for Microbiology, United States (Oct. 1988).
Wilson, K.H., et al., "Suppression of Clostridium difficile by Normal Hamster Cecal Flora and Prevention of Antibiotic-Associated Cecitis," Infection and Immunity, 34(2):626-628, American Society for Microbiology, United States (Nov. 1981).
Wilson, K.H., Sheagren, J.N., "Antagonism of Toxigenic Clostridium Difficile by Nontoxigenic C. Difficile," The Journal of Infectious Diseases, 147(4):733-736, Oxford University Press, England (Apr. 1983).
Wingender, G., et al., "Intestinal Microbes Affect Phenotypes and Functions of Invariant Natural Killer T Cells in Mice," Gastroenterology, 143(2):418-428, PA : W.B. Saunders,United States, (Aug. 2012).
Winter, J., et al., "*Clostridium orbiscindens* Sp. Nov., A Human Intestinal Bacterium Capable of Cleaving the Flavonoid C-Ring," International Journal of Systematic Bacteriology, 41(3):355-357, Society for General Microbiology, England (1991).
Woo, T.D., et al., "Inhibition of the Cytotoxic Effect of Clostridium Difficile in Vitro by Clostridium Butyricum Miyairi 588 Strain,"

(56) References Cited

OTHER PUBLICATIONS

Journal of Medical Microbiology, 60(Pt 11):1617-1625, Microbiology Society, England (Nov. 2011).
Wood et al., "Kraken: ultrafast metagenomic sequence classification usmg exact alignments," Genome Biology 15:R46 (2014).
Wortman, J. R., et al., "Design and evaluation of SER-262: A fermentation-derived microbiometherapeutic for the prevention of recurrence in patients with primary clostridium difficile infection," Seres Therapeutics, Cambridge, MA, Jun. 1, 2016, Retrived from (http://serestherapeutics.com/sites/default/files/wortman_asm_poster_final_poster_ser_262.pdf), Retrieved on [Mar. 6, 2017], 1 page.
Wrobel, B., "Statistical Measures of Uncertainty for Branches in Phylogenetic Trees Inferred From Molecular Sequences by Using Model-based Methods," Journal of Applied Genetics, 49(1):49-67, Springer, England (2008).
Wroblewski, D., et al., "Rapid Molecular Characterization of Clostridium Difficile and Assessment of Populations of C. Difficile in Stool Specimens," Journal of Clinical Microbiology, 47(7):2142-2148, American Society for Microbiology, United States (Jul. 2009).
Wu, G.Y. and Wu, C.H., "Delivery Systems for Gene Therapy," Biotherapy 3(1):87-95, Kluwer Academic Publishers, Netherlands (1991).
Wynendaele, E., et al., "Crosstalk between the microbiome and cancer cells by quorum sensing peptides", Peptides 65:40-48, Elsevier, Netherlands (2015).
Yamakawa, K., et al., "Enhancement of Clostridium Difficile Toxin Production in Biotin-limited Conditions," Journal of Medical Microbiology, 44(2):111-114, Microbiology Society, England (Feb. 1996).
Yamamura, H., et al., "Application of Sucrose-gradient Centrifugation for Selective Isolation of *Nocardia* Spp. From Soil," Journal of Applied Microbiology, 95(4):677-678, Published for the Society for Applied Bacteriology by Blackwell Science, England (2003).
Yang, W.W. (201 0). Fast Viability Assessment of Clostridium Spores Survival in Extreme Environments. PhD thesis California Institute of Technology.
Yang, W.W., et al., "Production and Characterization of Pure Clostridium Spore Suspensions," Journal of Applied Microbiology, 106(1):27-33, Published for the Society for Applied Bacteriology by Blackwell Science, England (Jan. 2009).
Yang, W.W., Ponce, A., "Rapid Endospore Viability Assay of Clostridium Sporogenes Spores," International Journal of Food Microbiology, 133(3):213-216, Elsevier Science Publishers, Netherlands (Aug. 2009).
Yang, W.W., Ponce, A., "Validation of a Clostridium Endospore Viability Assay and Analysis of Greenland Ices and Atacama Desert Soils," Applied and Environmental Microbiology, 77(7):2352-2358, American Society for Microbiology, United States (Jan. 2011).
Yen et al., "IL-23 is essential for T cell-mediated colitis and promotes inflammation via IL-17 and IL-6," The J oumal of Clinical Investigation 116( 5): 1310-1316 (2006).
Yi, Y., et al., "Current Advances in Retroviral Gene Therapy," Current Gene Therapy 11(3):218-228, Bentham Science Publishers, Netherlands (2011).
Yl, X., and Setlow, P., "Studies of the Commitment Step in the Germination of Spores of *Bacillus* Species," Journal of Bacteriology, 192(13):3424-3433, American Society for Microbiology, United States (Jul. 2010).
Yuguchi Hiroya et al., "Hakkonyuu/nyuusankin inryou to chounaikinsou Fermented Milk/Lactic Acid Bacteria Beverages and Intestinal Bacterial Flora," New Food Industry, 29(7):71-88 (1987).
Yung, P.T., and Ponce, A., "Fast Sterility Assessment by Germinable-Endospore Biodosimetry," Applied and Environmental Microbiology, 74(24):7669-7674, American Society for Microbiology, United States (Sep. 2008).
Yunoki, M., et al., "Heat Sensitivity of Human Parvovirus B19," Vox Sanguinis, 84(3):164-169, Blackwell Science, England (Apr. 2003).

Yutin, N. and Galperin, M.Y., "A Genomic Update on Clostridial Phylogeny: Gram-negative Spore Formers and Other Misplaced Clostridia," Environmental Microbiology 15(10):2631-2641, Blackwell Science, England (Oct. 2013).
Zar, F.A., "A Comparison of Vancomycin and Metronidazole for the Treatment of Clostridium Difficile-associated Diarrhea, Stratified by Disease Severity.," Clinical Infectious Diseases : an Official Publication of the Infectious Diseases Society of America, 45(3):302-307, Oxford University Press, United States, (Aug. 2007).
Ze, X., et al., "Ruminococcus Bromii Is a Keystone Species for the Degradation of Resistant Starch in the Human Colon,"The ISME Journal, 6(8): 1535-1543, Nature Publishing Group, England (Aug. 2012).
Zeng, Y., et al., "Towards Development of Stable Formulations of a Live Attenuated Bacterial Vaccine: a Preformulation Study Facilitated by a Biophysical Approach," Human Vaccines, 5(5):322-331, Landes Bioscience, United States (May 2009).
Zhao, J., et al., "Evaluation of Endospore Purification Methods Applied to Bacillus Cereus," Separation and Purification Technology, 61(3):341-347, Elsevier Ltd, Netherlands (Jul. 2008).
Zhao, Y., et al., "Rapsearch2: a Fast and Memory-efficient Protein Similarity Search Tool for Next-generation Sequencing Data.," Bioinformatics (Oxford, England), 28(1):125-126, Oxford University Press,England, (Jan. 2012).
Zhou, D., et al., "Total Fecal Microbiota Transplantation Alleviates Highfat Diet-Induced Steatohepatitis in Mice via Beneficial Regulation of Gut Microbiota," Scientific Reports 7(1):11 pages, Nature Publishing Group, England (May 2017).
Zhu, C., et al., "Bile Acids in Regulation of Inflammation and Immunity: Friend or Foe?," Clinical and Experimental Rheumatology 34(4 Suppl 98):25-31, Clinical and Experimental Rheumatology S.A.S, Italy (Jul.-Aug. 2016).
Zilberberg, M.D.,et al., "Increase in Adult Clostridium Difficile-related Hospitalizations and Case-fatality Rate, United States, 2000-2005.," Emerging Infectious Diseases, 14(6):929-931, National Center for Infectious Diseases, Centers for Disease Control and Prevention (CDC), United States., (Jun. 2008).
Bansal, T., et al., "The Bacterial Signal Indole Increases Epithelial-cell Tight-junction Resistance and Attenuates Indicators of Inflammation," Proceedings of the National Academy of Sciences of the United States of America 107(1):228-233, National Academy of Sciences, United States (Jan. 2010).
Baron, S. F., et al., "Cloning, sequencing, and expression of the gene coding for bile acid 7 alpha-hydroxysteroid dehydrogenase from *Eubacterium* sp. strain VPI 12708," Journal of Bacteriology 173(15):4558-4569, American Society for Microbiology, United States (Aug. 1991).
Best, E.L., et al., "Models for the Study of Clostridium Difficile Infection," Gut Microbes 3(2):145-167, Taylor & Francis, United States (Mar. 2012).
Bhattarai, Y., et al., "Gut Microbiota-Produced Tryptamine Activates an Epithelial G-Protein-Coupled Receptor to Increase Colonic Secretion," Cell Host & Microbe 23(6):775-785, Cell Press, United States (Jun. 2018).
Boffa, L.C., et al., "Suppression of Histone Deacetylation in Vivo and in Vitro by Sodium Butyrate," The Journal of Biological Chemistry 253(10):3364-3366, Elsevier Inc., United States (May 1978).
Candido, E.P., et al., "Sodium Butyrate Inhibits Histone Deacetylation in Cultured Cells," Cell 14(1):105-113, Cell Press, United States (May 1978).
Cassir, N., et al., "Clostridium Butyricum: From Beneficial to a New Emerging Pathogen," Clinical Microbiology and Infection: the Official Publication of the European Society of Clinical Microbiology and Infectious Diseases 22(1):37-45, Elsevier, England (Jan. 2016).
Crum-Cianflone, N., "Clostridium innocuum Bacteremia in a patient with acquired immunodeficiency syndrome," Am J Med Sci 337(6):480-482, Elsevier, Netherlands (Jun. 2009).
Davie, J.R., "Inhibition of Histone Deacetylase Activity by Butyrate," The Journal of Nutrition 133(Suppl 7):2485S-2493S, American Society for Nutrition, United States (Jul. 2003).

(56) References Cited

OTHER PUBLICATIONS

Devlin, A. S., and Fischbach, M. A., "A biosynthetic pathway for a prominent class of microbiota-derived bile acids," Nature Chemical Biology 11(9):685-690, Nature Pub. Group, United Kingdom (Sep. 2015).
Elsayed, S., and Zhang, K., "Bacteremia caused by Clostridium symbiosum," J Clin Microbiol 42(9): 4390-4392, American Society for Microbiology, United States (Sep. 2004).
Extended European Search Report for EP Application No. 18865081.6, European Patent Office, Munich, Germany, mailed on Jul. 6, 2021, 8 pages.
Final Office Action mailed Jun. 23, 2020, in U.S. Appl. No. 16/051,747, Von Maltzahn, G., et al., filed Aug. 1, 2018, 38 pages.
Final Office Action mailed Mar. 1, 2022, in U.S. Appl. No. 16/051,747, Von Maltzahn, G., et al., filed Aug. 1, 2018, 25 pages.
Final Office Action mailed Mar. 15, 2021, in U.S. Appl. No. 15/603,916, Van Den Brink; M., et al., filed May 24, 2017, 25 pages.
Final Office Action mailed Nov. 23, 2021, in U.S. Appl. No. 15/778,095, Button, J., et al., filed May 22, 2018, 10 pages.
Final Office Action mailed Sep. 8, 2020, in U.S. Appl. No. 16/054,864, Mckenzie, G., et al., filed Aug. 3, 2018, 7 pages.
Garsin, D.A., "Ethanolamine Utilization in Bacterial Pathogens: Roles and Regulation," Nature Reviews. Microbiology 8(4):290-295, Nature Pub. Group, United Kingdom (Apr. 2010).
Ge, X., et al., "Antibiotics-induced Depletion of Mice Microbiota Induces Changes in Host Serotonin Biosynthesis and Intestinal Motility," Journal of Translational Medicine 15(1):13, 9 pages, BioMed Central, United Kingdom (Jan. 2017).
Govender M., et al., "A Review of the Advancements in Probiotic Delivery: Conventional vs. Non-conventional Formulations for Intestinal Flora Supplementation," AAPS PharmSciTech 15(1): 29-43, Springer Science+Business Media, Germany (Feb. 2014).
Hafiz, S. and Oakley, C.L., "Clostridium Difficile: Isolation and Characteristics," Journal of Medical Microbiology 9(2):129-136, Microbiology Society, United Kingdom (May 1976).
Halley, F., et al., "A Bioluminogenic HDAC Activity Assay: Validation and Screening," Journal of Biomolecular Screening 16(10):1227-1235, Sage Publications, United States (Dec. 2011).
Huang, K., et al., "MetaRef: A Pan-genomic Database for Comparative and Community Microbial Genomics," Nucleic Acids Research 42(Database issue):D617-D624, Oxford University Press, United Kingdom (published online Nov. 2013, published in print 2014).
Hubbard, T.D., et al., "Indole and Tryptophan Metabolism: Endogenous and Dietary Routes to Ah Receptor Activation," Drug Metabolism and Disposition: The Biological Fate of Chemicals 43(10):1522-1535, American Society for Pharmacology and Experimental Therapeutics, United States (Oct. 2015).
Hutton, M.L., et al., "Small Animal Models for the Study of Clostridium Difficile Disease Pathogenesis," FEMS Microbiology Letters 352(2):140-149, Oxford University Press, United Kingdom (Mar. 2014).
International Search Report and Written Opinion for International Application No. PCT/US2018/054252, ISA/US, United States, mailed on Jan. 24, 2019, 14 pages.
Jenq, R., et al., "Identification of Intestinal Commensal Bacteria Protective Against GVHD in Mice and Humans," Transplantation and Cellular Therapy 20(2):S22-S23, Abstract 1, American Society for Transplantation and Cellular Therapy, United States (Feb. 2014).
Julliard, W., et al., "Amelioration of Clostridium difficile Infection in Mice by Dietary Supplementation With Indole-3-carbinol," Annals of Surgery 265(6):1183-1191, Lippincott Williams & Wilkins, United States (Jun. 2017).
Kakiyama, G., et al., "A Simple and Accurate HPLC Method for Fecal Bile Acid Profile in Healthy and Cirrhotic Subjects: Validation by GC-MS and LC-MS," Journal of Lipid Research 55(5):978-990, Elsevier, United States (May 2014).
Keeney, K.M., et al., "Effects of Antibiotics on Human Microbiota and Subsequent Disease," Annual Review of Microbiology 68:217-235, Annual Reviews, United States (2014).
Latham, T., et al., "Lactate, a Product of Glycolytic Metabolism, Inhibits Histone Deacetylase Activity and Promotes Changes in Gene Expression," Nucleic Acids Research 40(11):4794-4803, Oxford University Press, United Kingdom (Jun. 2012).
Lombard, G.L. and Dowell, V.R., "Comparison of Three Reagents for Detecting Indole Production by Anaerobic Bacteria in Microtest Systems," Journal of Clinical Microbiology 18(3):609-613, American Society for Microbiology, United States (Sep. 1983).
Millan, B., et al., "Fecal Microbial Transplants Reduce Antibiotic-resistant Genes in Patients With Recurrent Clostridium difficile Infection," Clin Infect Dis 62(12):1479-1486, Oxford University Press, United Kingdom (Jun. 2016).
Minnullina, Z. S., et al., "Bile acids serum levels in patients with nonalcoholic fatty liver disease," Kazan Medical Journal 96(3):354-358, accessed at URL:[https://kazanmedjournal.ru/kazanmedj/article/view/1664/1281] on May 27, 2022, Eco-Vector, Russia (2015).
Mortensen, et al., "Re-evaluation of Glycerol (E 422) as a Food Additive," European Food Safety Authority 15(3): 1-64, John Wiley and Sons, United States (Mar. 2017).
NCT02830542, "SER-262 Versus Placebo in Adults With Primary Clostridium Difficile Infection to Prevent Recurrence," ClinicalTrials.gov, first posted Jul. 13, 2016, sponsored by Seres Therapeutics, Inc., accessed at ( https://clinicaltrials.gov/ct2/show/record/NCT02830542 ) on Sep. 3, 2022, 7 pages.
Ng, K. M., et al., "Microbiota-liberated Host Sugars Facilitate Post-antibiotic Expansion of Enteric Pathogens," Nature 502(7469):96-99, Nature Publishing Group, United Kingdom (Oct. 2013).
Office Action mailed Aug. 4, 2021, in U.S. Appl. No. 16/051,747, Von Maltzahn, G., et al., filed Aug. 1, 2018, 33 pages.
Office Action mailed Dec. 30, 2021, in U.S. Appl. No. 15/603,916, Van Den Brink; M., et al., filed May 24, 2017, 24 pages.
Office Action mailed Feb. 15, 2022, in U.S. Appl. No. 17/120,671, Henn, M. R., et al., filed Dec. 14, 2020, 7 pages.
Office Action mailed Feb. 24, 2022, in U.S. Appl. No. 17/120,666, Henn, M. R., et al., filed Dec. 14, 2020, 9 pages.
Office Action mailed Feb. 8, 2021, in U.S. Appl. No. 14/765,814, Cook, D. N., et al., filed Aug. 4, 2015, 9 pages.
Office Action mailed Jun. 18, 2020, in U.S. Appl. No. 15/603,916, Van Den Brink; M., et al., filed May 24, 2017, 22 pages.
Office Action mailed Jun. 28, 2021, in U.S. Appl. No. 15/778,095, Button, J., et al., filed May 22, 2018, 12 pages.
Office Action mailed May 3, 2021, in U.S. Appl. No. 16/230,807, Henn, M. R., et al., filed Dec. 21, 2018, 17 pages.
Pickard, J.M. and Chervonsky, A.V., "Intestinal Fucose as a Mediator of Host-microbe Symbiosis," Journal of Immunology 194(12):5588-5893, American Association of Immunologists, United States (Jun. 2015).
Romagnoli, P.A., et al., "Commensal Metabolite Indol-3-propionic Acid Promotes Gut Barrier Function by Regulating IL-22 Production During Intestinal Inflammatory Conditions," The Journal of Immunology 196 (1 Supplement):67.10, The American Association of Immunologists, Inc., United States (May 2016).
Sealy, L. and Chalkley, R., "The Effect of Sodium Butyrate on Histone Modification," Cell 14(1): 115-121, Cell Press, United States (May 1978).
Sebaihia, M., et al., "The Multidrug-resistant Human Pathogen Clostridium Difficile has a Highly Mobile, Mosaic Genome," Nature Genetics 38(7):779-786, Nature Pub. Co., United Kingdom (Jul. 2006).
Shenderov, B. A., "Medical microbial ecology and functional nutrition. Volume III: Probiotics and functional nutrition," p. 51, GRANT Publishing House, Russia (2001).
Sridharan, G.V., et al., "Prediction and Quantification of Bioactive Microbiota Metabolites in the Mouse Gut," Nature Communications 5:5492, 13 pages, Nature Pub. Group, United Kingdom (Nov. 2014).
Takaki, M., et al., "Physiological Responses of Guinea-pig Myenteric Neurons Secondary to the Release of Endogenous Serotonin by Tryptamine," Neuroscience 16(1):223-240, Elsevier Science, United States (Sep. 1985).
Tanaka, H., et al., "Screening of Lactic Acid Bacteria for Bile Salt Hydrolase Activity," Journal of Dairy Science 82(12):2530-2535, American Dairy Science Association, United States (Dec. 1999).

(56) References Cited

OTHER PUBLICATIONS

Truong, D.T., et al., "MetaPhlAn2 for Enhanced Metagenomic Taxonomic Profiling," Nature Methods 12(10):902-903, Nature Pub. Group, United Kingdom (Oct. 2015).
Venkatesh, M., et al., "Symbiotic Bacterial Metabolites Regulate Gastrointestinal Barrier Function via the Xenobiotic Sensor PXR and Toll-like Receptor 4," Immunity 41(2):296-310, Cell Press, United States (Aug. 2014).
Vidali, G., et al., "Butyrate Suppression of Histone Deacetylation Leads to Accumulation of Multiacetylated Forms of Histones H3 and H4 and Increased DNase I Sensitivity of the Associated DNA Sequences," Proc Natl Acad Sci USA 75(5):2239-2243, National Academy of Sciences, United States (May 1978).
Vinogradova, K. A., et al., "Microbial antibiotic resistance: resistome, its volume diversity and development," Antibiotics and Chemotherapy 58(5-6):38-48, Media Sphera Publishing Group, Russian Federation (2013).
Waldecker, M., et al., "Inhibition of Histone-deacetylase Activity by Short-chain Fatty Acids and Some Polyphenol Metabolites Formed in the Colon," The Journal of Nutritional Biochemistry 19(9):587-593, Elsevier Science, United States (Sep. 2008).
Williams, B.B., et al., "Discovery and Characterization of Gut Microbiota Decarboxylases That Can Produce the Neurotransmitter Tryptamine," Cell Host & Microbe 16(4):495-503, Cell Press, United States (Oct. 2014).
Yano, J.M., et al., "Indigenous Bacteria From the Gut Microbiota Regulate Host Serotonin Biosynthesis," Cell 161(2):264-276, Cell Press, United States (Apr. 2015).
Zhang, L.S. and Davies, S.S., "Microbial Metabolism of Dietary Components to Bioactive Metabolites: Opportunities for New Therapeutic Interventions," Genome Medicine 8(1):46, BioMed Central, United Kingdom (Apr. 2016).
Johnson, J., et al., "Evaluation of 16S rRNA gene sequencing for species and strain-level microbiome analysis," Nature Communications 10(1):5029, Nature Publishing Group, United Kingdom (Nov. 2019).
Alonso C.D, et al., "Epidemiology and Outcomes of Clostridium Difficile Infections in Hematopoietic Stem Cell Transplant Recipients," Clinical Infectious Diseases 54(8):1053-1063, Oxford University Press, United States (2012).
Antharam, V.C., "Intestinal Dysbiosis and Depletion of Butyrogenic Bacteria in Clostridium Difficile Infection and Nosocomial Diarrhea," Journal of Clinical Microbiology 51(9):2884-2892, American Society for Microbiology, United States (Sep. 2013).
Arunachalam, R., et al., "Molecular Phylogenetic Approach for Classification of *Salmonella typhi,*" Research Journal of Microbiology 7(1):13-22, Elsevier, Netherlands (2012).
Bekkum., D.W.V., et al., "Mitigation of Secondary Disease of Allogeneic Mouse Radiation Chimeras by Modification of the Intestinal Microflora," Journal of the National Cancer Institute 52:401-404, Oxford University Press, United States (1974).
Bultman, S.J., "Emerging Roles of the Microbiome in Cancer," Carcinogenesis, 35(2):249-255, Irl Press at Oxford University Press, United Kingdom (Feb. 2014).
Callejas-Diaz, A., et al., "Clostridium Difficile: Deleterious Impact on Hematopoietic Stem Cell Transplantation," Current Hematologic Malignancy Reports 9(1):85-90, Current Science, United States (2014).
Carding, S., et al., "Dysbiosis of the gut microbiota in disease," Micro Ecol Health Dis 26:26191, Taylor and Francis, United Kingdom (Feb. 2015).
Chakrabarti, S., et al., "Clostridium Difficile Infection in Allogeneic Stem Cell Transplant Recipients is Associated With Severe Graft-versus-host Disease and Non-relapse Mortality," Bone Marrow Transplantation 26(8):871-876, Nature Publishing Group, England (2000).
Clarridge, J. E., "Impact of 16s rRNA Gene Sequence Analysis for Identification of Bacteria on Clinical Microbiology and Infectious Diseases," Clinical Microbiology Reviews 17(4):840-862, American Society for Microbiology, United States (Oct. 2004).
Clevers, H., et al., "Stem cell signaling. An integral program for tissue renewal and regeneration: Wnt signaling and stem cell control," Science 346(6205):1248012, American Association for the Advancement of Science, United States (Oct. 2014).
ClinicalTrials.gov Identifier: NCT02618187, "A Study to Evaluate the Safety, Tolerability and Microbiome Dynamics of SER-287 in Subjects With Mild-to-Moderate Ulcerative Colitis," accessed at (www.clinicaltrials.gov/ct2/show/NCT02618187?term=SERES-101&rank=1).
Extended European Search Report dated Jul. 26, 2019 in EP Application No. 16869296.
Gennaro, A.R., Editor "Remington's Pharmaceutical Sciences", 18th Edition, Mack Publishing Co., 5 pages, 1990 (Table of Contents).
International Search Report and Written Opinion for International Application No. PCT/US2019/034069, ISA/US, mailed on Oct. 17, 2019, 15 pages.
International Search Report and Written Opinion for International Application No. PCT/US2016/050269 mailed Jan. 24, 2017, 12 pages.
International Search Report for International Application No. PCT/US2016/063643 mailed Mar. 9, 2017, 5 pages.
Jin, U.-H., et al., "Short Chain Fatty Acids Enhance Aryl Hydrocarbon (Ah) Responsiveness in Mouse Colonocytes and Caco-2 Human Colon Cancer Cells," Sci Rep 7(10):10163, Springer, Germany (Aug. 2017).
Khan, A.A., et al., "Identification of Predominant Human and Animal Anaerobic Intestinal Bacterial Species by Terminal Restriction Fragment Patterns (TRFPs): a Rapid, PCR-based Method," Molecular and Cellular Probes, 15(6):349-355, Academic Press, United Kingdom (Dec. 2001).
Krafft A.E. and Hyle P.B., "Purification and Characterization of a Novel Form of 20 Alpha-hydroxysteroid Dehydrogenase From Clostridium Scindens," Journal of Bacteriology, 171(6):2925-2932, American Society for Microbiology, United States (Jun. 1989).
Lee, S.H., "Intestinal permeability regulation by tight junction: implication on inflammatory bowel diseases," Intest Res 13:11-18, Korean Association for the Study of Intestinal Diseases, Korea (Jan. 2015).
Ligt, M.T.V., et al., "ST2 as a Marker for Risk of Therapy-Resistant Graft-versus Host Disease and Death," The New England Journal of Medicine 369:529-539, Massachusetts Medical Society, United States (2013).
Lloyd-Price, J., et al., "Strains, functions and dynamics in the expanded Human Microbiome Project," Nature 550:61-66, Springer, Germany (Sep. 2017).
Moayyedi, P., et al., "Fecal Microbiota Transplantation Induces Remission in Patients With Active Ulcerative Colitis in a Randomized Controlled Trial," Gastroenterology 149(1):102-109, Elsevier, Netherlands (Jul. 2015).
NCB I. Blautia producta. Datasheet [onling]. Retrieved on Jun. 8, 2020. Downloaded from the internet: https://www.ncbi.nlrn.nih.gov/Taxonorny/Browser/wwwtax.cgi?rnode=Info&id=33035 pp. 1-3. specif. 1 page.
Zakrzewski, J.L., et al., "Adoptive transfer of T-cell precursors enhances T-cell reconstitution after allogeneic hematopoietic stem cell transplantation," Nature Medicine 12(9): 1039-1047, Nature Publishing Company, United States (2006).
Non Final Office Action mailed Jun. 9, 2020, in U.S. Appl. No. 16/523,414, Eric Pamer et al., filed Jul. 26, 2019, 10 pages.
Office Action dated Aug. 28, 2020 corresponding to Japanese Patent Application No. 2018-511660.
Office Action mailed Feb. 15, 2022, in U.S. Appl. No. 17/120,657, Henn, M. R., et al., filed Dec. 14, 2020, 7 pages.
Office Action mailed Feb. 8, 2021, in U.S. Appl. No. 14/765,814, Cook; D., et al., filed Aug. 4, 2015, 9 pages.
Paramsothy, S., et al., "Multidonor intensive faecal microbiota transplantation for active ulcerative colitis: a randomised placebo-controlled trial," Lancet 389(10075):1218-1228, Elsevier, Netherlands (Mar. 2017).

(56) References Cited

OTHER PUBLICATIONS

Park, Y.W., "Comparison of Mineral and Cholesterol Composition of Different Commercial Goat Milk Products Manufactured in USA," Small Ruminant Research 37(1-2):115-124, Elsevier, Netherlands (Jul. 2000).
Passel, M.W.J., et al., "The Genome of Akkermansia muciniphila, a Dedicated Intestinal Mucin Degrader, and Its Use in Exploring Intestinal Metagenomes," PLoS ONE 6(3):e16876, Public Library of Science, United States (2011).
Peled, J.U., et al., "Intestinal Microbiota and Relapse After Hematopoietic-cell Transplantation," Official Journal of the American Society of Clinical Oncology, 35(15):1650-1659, American Society of Clinical Oncology, United States (May 2017).
Preamble and Precautionary Statements Regarding Amendment and Argument, European Application No. 11728077.6, Feb. 25, 2014, 6 pages.
Printout of Taxonomy browser—Blautia coccoides, downloaded on Sep. 29, 2022 from the website: https://www.ncbi.nlm.nih.gov/Taxonomy/Browser/wwwtax.cgi?id=1532 (Year: 2022).
Riley, T.V., et al., "Comparison of Alcohol Shock Enrichment and Selective Enrichment for theIsolation of Clostridium Difficile," Epidemiology and Infection 99(2):355-359, Cambridge University Press, England (Oct. 1987).
Russell, W.R., et al., "High-protein, Reduced-carbohydrate Weight-loss Diets Promote Metabolite Profiles Likely to Be Detrimental to Colonic Health," The American Journal of Clinical Nutrition 93(5):1062-1072, American Society for Nutrition, United States (2011).
Santos-De-Frutos, K. and Djouder, N., "When Dormancy Fuels Tumour Relapse," Communications Biology, 4(1):747 1-12, Nature Publishing Group, United Kingdom (Jun. 2021).
Scott, K.J. and Bishop, D.R., "Nutrient Content of Milk and Milk Products: Vitamins of the B Complex and Vitamin C in Retail Market Milk and Milk Products," International Journal of Dairy Technology 39(1): 32-35, Wiley Online Library, United States (Jan. 1986).
Serody J, "Bacterial Sepsis and Gi Tract Gvhd: More Commensal Than You Think," Blood 120(1):6-7, Elsevier, United States (2012).
Shono, et al., "Bone Marrow Graft-versus-Host Disease: Evaluation of Its Clinical Impact onDisrupted Hematopoiesis after Allogeneic Hematopoietic Stem Cell Transplantation," Biol Blood Marrow Transplant 20:495-500, Carden Jennings Publishing, United States (2014).
Shono, et al., "Intestinal microbiota-related effects on graft-versus-host disease," International Journal of Hematology 101:428-437, Springer Japan, Japan (2015).
Smith, P.M., et al., "The Microbial Metabolites, Short-Chain Fatty Acids, Regulate Colonic Treg Cell Homeostasis," Science 341:569-573, American Association for the Advancement of Science, United States (2013).
Summary of Clinical Trial List, Search of: NCT02618187, ClinicalTrials.gov, accessed at https:/clinicaltrials.gov/study/NCT02618187?term=NCT02618187&rank=1, accessed on Oct. 20, 2023, 11 pages.
Sungkanuparph, S., et al., "Eubacterium Bacteremia and Colon Cancer," Scandinavian Journal of Infectious Diseases, Scandinavian Journal of Infectious Diseases, 34(12):941-943, Society for the Publication of Acta medica Scandinavica, United Kingdom (2002).
Supplementary Partial European Search Report dated Apr. 25, 2019 in Application No. EP 16843142.
Takashima, S., et al., "The Wnt agonist R-spondinl regulates systemic graft-versus-host disease by protecting intestinal stem cells," Journal of Experimental Medicine 208(2):285-294, (Jan. 2011).
Ursell, L. K., et al., "Defining the Human Microbiome," Nutr Rev 70(Suppl 1):S38-S44, Oxford University Press, United Kingdom (2012).
Vaisnava, S., et al., "The Antibacterial Lectin Regiiiy Promotes the Spatial Segregation of Microbiota and Host in the Intestine," Science 334:255-258, American Association for the Advancement of Science, United States (2011).
Vandussen, K.L., et al., "Development of an enhanced human gastrointestinal epithelial culture system to facilitate patient-based assays," Gut 64(6):911-920, BMJ Group, United Kingdom (2015).
Vossen, J.M., et al., "Prevention of Infection and Graft-versus-Host Disease by Suppression of Intestinal Microflora in Children Treated with Allogeneic Bone Marrow Transplantation," European Journal of Clinical Microbiology & Infectious Diseases 9(1): 14-23, Springer, Germany (1990).
Walter, J., et al., "To engraft or not to engraft: an ecological framework for gut microbiome modulation with live microbes," Curr Opin Biotechnol 49:129-139, Elsevier, Netherlands (Feb. 2018).
Wang, R.F., "DNA Microarray Analysis of Predominant Human Intestinal Bacteria in Fecal Samples," Molecular and Cellular Probes, 18(4):223-234, Academic Press, United Kingdom (Aug. 2004).
Weisdorf, D., et al., "Risk Factors for Acute Graft-versus-host Disease in Histocompatible Donor Bone Marrow Transplantation," Transplantation 51:1197-1203, Lippincott Williams & Wilkins, United States (1991).
Wingard, J.R., et al., "Opportunistic infections after blood and marrow transplantation," Transplant Infectious Disease 1:3-20, Munksgaard, Denmark (1999).
Yang, J., et al., "In vitro characterization of the impact of selected dietary fibers on fecal microbiota composition and short chain fatty acid production," Anaerobe 23:74-81, Elsevier, Netherlands (Oct. 2013).

* cited by examiner

COMPOSITIONS AND METHODS FOR TREATING ANTIBIOTIC RESISTANCE

FIELD OF THE INVENTION

The invention relates to preventing and treating antibiotic resistance.

BACKGROUND

According to the World Health Organization (WHO), bacterial "[a]ntibiotic resistance is one of the biggest threats to global health, food security, and development today" (who.int/mediacentre/factsheets/antibiotic-resistance/en). Antibiotic resistance can occur naturally in bacteria but is greatly exacerbated by increasing use and misuse of antibiotics. Adding to the problem is the diversity of antibiotic resistance mechanisms; a variety of disparate genes can confer resistance, and unrelated bacteria can horizontally transmit antibiotic resistance genes. The WHO has also stated "[w]hile there are some new antibiotics in development, none of them are expected to be effective against the most dangerous forms of antibiotic-resistant bacteria (ibid)."

Accordingly, it is imperative that new methods of reducing antibiotic resistance be developed and made available.

SUMMARY

The invention relates to the discovery that bacterial compositions can be used to reduce the abundance of antibiotic resistance genes in the gastrointestinal (GI) microbiome of a subject.

The invention provides compositions including a therapeutically effective amount of a microbiome composition comprising spore-former bacteria for use in reducing the abundance of at least one antibiotic-resistance gene in the microbiome of a subject.

The invention also provides compositions including a therapeutically effective amount of a microbiome composition comprising *Firmicutes* derived from one or more healthy human subjects for use in treating a subject at risk for or diagnosed with an undesirable level or population of drug-resistant bacteria.

The invention further provides ROAR compositions for use reducing the abundance of antibiotic-resistant bacteria in the microbiome of a subject.

The invention additionally provides ROAR compositions for use in disrupting a transmission cycle of antibiotic resistance genes, by administration to at least two individuals with a high likelihood of direct or indirect contact, including optionally contact with a bodily fluid or waste.

In addition, the invention provides methods of reducing the abundance of at least one antibiotic-resistance gene in the microbiome of a subject, the methods including administering a therapeutically effective amount of a microbiome composition containing spore-former bacteria.

The invention also provides methods of treating a subject at risk for or diagnosed with an undesirable level or population of drug-resistant bacteria, the methods including administering a therapeutically effective amount of a microbiome composition containing *Firmicutes* derived from one or more healthy human subjects.

The invention further provides methods of reducing the abundance of antibiotic-resistant bacteria in the microbiome of a subject, the methods including administering a therapeutically effective amount of a ROAR composition.

The invention additional provides methods of disrupting a transmission cycle of antibiotic resistance genes, the methods including administering a ROAR composition to at least two individuals with a high likelihood of direct or indirect contact including contact with a bodily fluid or waste.

Various embodiments of any of the methods noted above are as set forth below.

In some embodiments, the antibiotic-resistance gene(s) is selected from those listed in Table 1.

In some embodiments, the abundance of at least 2, 3, 4, 5, 6, 7, 8, 9, 10, or more antibiotic resistance genes of Table 1 is reduced.

In some embodiments, the drug or antibiotic is from a drug class listed in Table 2.

In some embodiments, the methods further include, or the compositions for use further result in, reducing the abundance of 1, 2, 3, 4, 5, 6, 7, 8, 9, 10, 11, 12, 13, 14, 15, 16, 17, 18, 19, 20, 21, 22, 23, 24, 25, or more antibiotic resistant genes or drug classes.

In some embodiments, the composition includes one or more species listed in Table 3. In some embodiments, the species listed in Table 3 is not also listed in Table 4. The composition may be administered by a method described above or elsewhere herein.

In some embodiments, the composition includes 2, 3, 4, 5, 6, 7, 8, 9, 10, 11, 12, 13, 14, 15, 16, 17, 18, 19, 20, or more species listed in Table 3. In some embodiments, the species listed in Table 3 is not also listed in Table 4. The composition may be administered by a method described above or elsewhere herein.

In some embodiments, the species include a 16S rDNA, V4, and/or V6 sequence listed in Table 5, or a sequence having at least 95% identity thereto. The species may be administered by a method described above or elsewhere herein.

In some embodiments, the composition does not include one or more species of Table 4. In some embodiments, the species listed in Table 4 that is not included is not listed Table 3. The composition may be administered by a method described above or elsewhere herein.

In some embodiments, the species does not include a 16S rDNA, V4, and/or V6 sequence listed in Table 6, or a sequence having at least 95% identity thereto. The species may be administered by a method described above or elsewhere herein.

In some embodiments the bacteria in the composition are in the form of spores.

In some embodiments, the bacteria in the composition are cultured.

In some embodiments, the composition includes *Firmicutes* and one or more species of *Bacteroides.*

In some embodiments, the subject has a reduced abundance of one, two, or three bacteria selected from the group consisting of quinolone resistant, beta-lactam-resistant, and carbapenem-resistant bacteria.

In some embodiments, the subject has been unresponsive to antibiotic treatment.

In some embodiments, the subject has or is at risk of developing *C. difficile* infection or disease, or a colitis wherein, in some embodiments, the colitis is optionally Crohn's disease or ulcerative colitis (e.g., mild to moderate ulcerative colitis). In some embodiments, the subject does not have (or is not risk of developing) *C. difficile* infection or disease, or a colitis (such as Crohn's disease or ulcerative colitis, e.g., mild to moderate ulcerative colitis).

The invention also provides compositions including bacterial species associated with a decrease in the abundance of at least one antibiotic resistance gene in a subject.

In some embodiments, the antibiotic-resistance gene(s) is selected from those listed in Table 1.

In some embodiments, the abundance of at least 2, 3, 4, 5, 6, 7, 8, 9, 10, or more antibiotic resistance genes of Table 1 is decreased.

In some embodiments, the antibiotic is from a class listed in Table 2.

In some embodiments, the composition includes one or more species listed in Table 3. In some embodiments, the species listed in Table 3 is not also listed in Table 4.

In some embodiments, the composition includes 2, 3, 4, 5, 6, 7, 8, 9, 10, 11, 12, 13, 14, 15, 16, 17, 18, 19, 20, or more species listed in Table 3. In some embodiments, the species listed in Table 3 is not also listed in Table 4.

In some embodiments, the species include a 16S rDNA, V4, and/or V6 sequence listed in Table 5, or a sequence having at least 95% identity thereto.

In some embodiments, the composition does not include one or more species of Table 4. In some embodiments, the species of Table 4 that is not included is not listed in Table 3.

In some embodiments, the species do not include a 16S rDNA, V4, and/or V6 sequence listed in Table 6, or a sequence having at least 95% identity thereto.

In some embodiments, the composition includes one or more species of *Firmicutes*.

In some embodiments, the composition includes one or more species of *Bacteroides*.

In some embodiments, the bacteria in the composition are in the form of spores.

In some embodiments, the bacteria in the composition are obtained from a spore fraction derived from feces of a healthy subject.

In some embodiments, the composition includes one or more species of *Firmicutes*, and optionally one or more species of *Bacteroides*, as the sole bacterial species in the composition.

In some embodiments, the bacteria in the composition are cultured.

The invention further provides compositions including bacteria for use in decreasing the abundance of at least one antibiotic resistance gene in a subject to whom the composition is administered.

In some embodiments, the bacteria in the composition are obtained from a spore fraction derived from feces of a healthy subject.

In some embodiments, the bacteria are selected for being associated with a decrease in the abundance of one or more antibiotic resistance genes in a subject.

In some embodiments, the antibiotic resistance gene(s) is selected from Table 1.

In some embodiments, the composition includes at least one species selected from Table 3.

In some embodiments, the composition does not include a species of Table 4.

The invention also provides methods for identifying a bacterial composition useful for decreasing the abundance of at least one antibiotic resistance gene in a subject to whom the composition is administered, the methods including screening the composition for the presence of one or more bacterial species of Table 3, wherein detection of one or more species of Table 3 in the bacterial composition indicates the identification of a composition that can be used to decrease the abundance of at least one antibiotic resistance gene. In some embodiments, the species of Table 3 is not also listed in Table 4.

In some embodiments, the screening includes detection of one or more 16S rDNA, V4, and/or V6 sequences of Table 5 in the composition, or a sequence having at least 95% identity thereto.

In some embodiments, the methods further include screening for the presence of one or more bacterial species of Table 4. In some embodiments, the species screened for from Table 4 is also not listed in Table 3.

In some embodiments, the screening includes detection of one or more 16S rDNA, V4, and/or V6 sequences of Table 6 in the composition, or a sequence having at least 95% identity thereto.

The invention also includes methods for screening a potential donor of feces for use in therapeutic methods, the methods including testing a feces sample from the potential donor for the presence of a bacterial species from Table 3 or Table 4, wherein detection of one or more species from Table 3 indicates that the potential donor may proceed to become a donor, while detection of one or more species from Table 4 indicates that the potential donor should not become a donor. In some embodiments, the species from Table 3 tested for is not listed in Table 4. In some embodiments, the species from Table 4 tested for is not listed in Table 3.

The invention further includes methods for determining whether a subject could benefit from treatment with a ROAR composition, the methods including determining whether a sample from the subject includes one or more species of bacteria from Table 4, wherein detection of one or more species from Table 4 indicates that the subject may benefit from treatment with a ROAR composition. In some embodiments, the species from Table 3 tested for is not listed in Table 4. In some embodiments, the species from Table 4 tested for is not listed in Table 3.

The invention further provides compositions (e.g., the compositions described above and elsewhere herein), wherein the bacteria in the compositions demonstrate the ability to decrease the abundance of one or more antibiotic resistance gene(s) in an animal model of antibiotic resistance. In some embodiments, the animal model is a mouse treated with one or more antibiotics and then colonized with one or more bacteria harboring one or more antibiotic resistance genes. In some embodiments, the mice are colonized with vancomycin resistant bacteria or vancomycin and carbapenem resistant bacteria.

The invention also includes use of the compositions described herein for the purposes specified in the methods described herein, as well as the use of these compositions for the preparation of medicaments for these uses.

The entire disclosure of each patent document and scientific article referred to herein, and those patent documents and scientific articles cited thereby, is expressly incorporated by reference herein for all purposes.

Additional features and advantages of the invention are more particularly described below.

DETAILED DESCRIPTION

Figure 1:
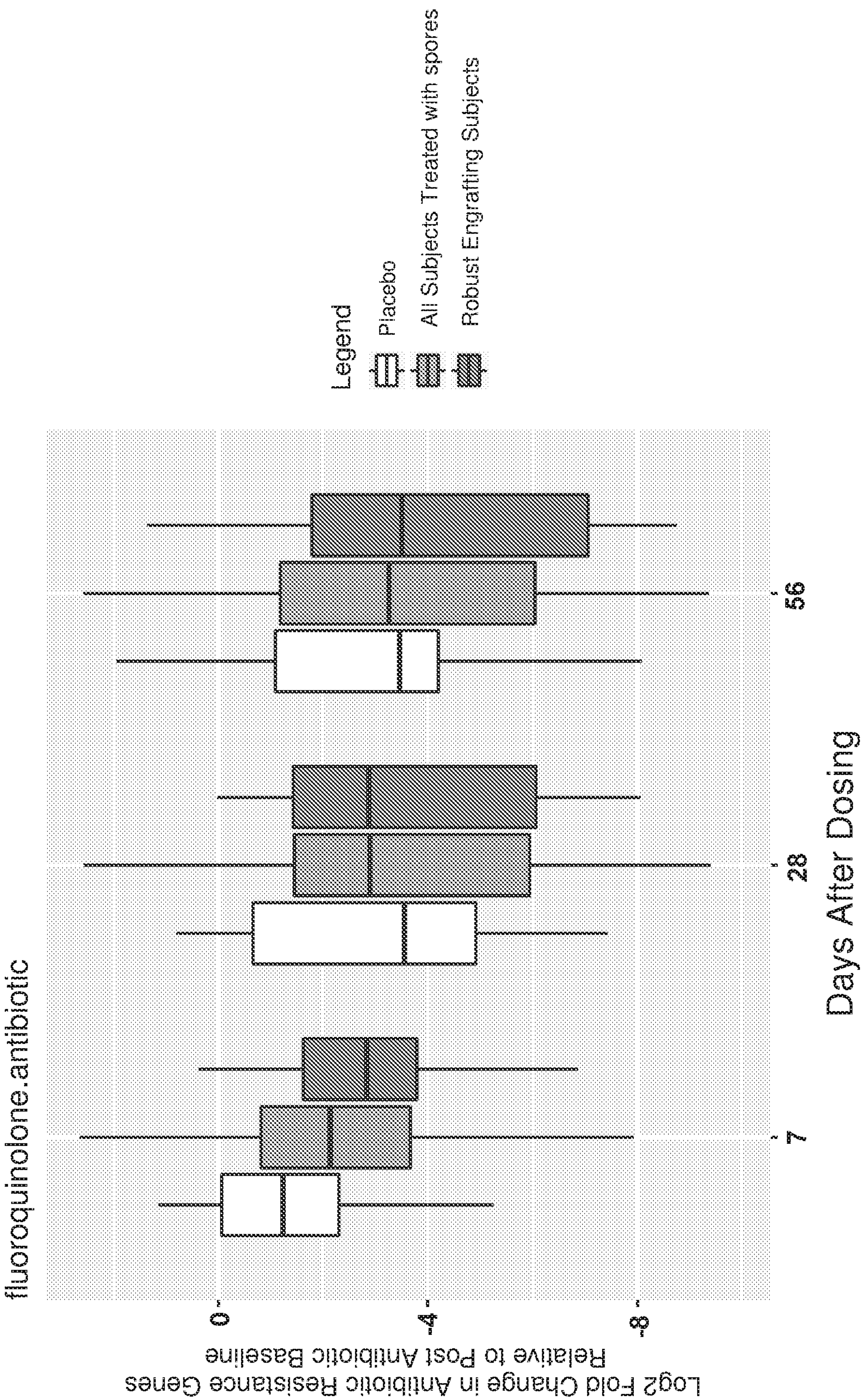
FIG. 1 is a graph depicting the results of an experiment detecting the reduction of genes associated with fluoroquinolone resistance in human subjects 7, 28, and 56 days after dosing with a human commensal spore composition. White=subjects who received placebo, medium gray=all subjects treated with the spore composition, and dark gray=results from the subset of subjects with a significant engraftment signal.

Antibiotic resistance (referred to herein as "AbxR") is a growing global public health issue. Resistance to all classes of antibiotics has been reported in all parts of the world (2014*, Antimicrobial Resistance, Global Report on Surveillance, Summary*, WHO) and development of conventional antibiotics has been relatively slow compared to the demand. For example, no new classes of antibiotics have been commercialized since the discovery of the lipopeptide antibiotic daptomycin in the 1980s. Furthermore, antibiotic stewardship programs that limit antibiotic use do not immediately reverse the trend of increasing resistance.

Applicants have discovered that treating a subject with a composition comprising bacteria, for example, spore-former bacteria derived from a healthy human, can reduce the abundance of AbxR genes (collectively, the "gut resistome") in a human subject. Such compositions are referred to herein as reduction of antibiotic resistance compositions (ROAR compositions).

Furthermore, such treatment can reduce the abundance of AbxR genes associated with resistance to multiple classes of antibiotics, e.g., β-lactams (including carbapenems), quinolones, glycopeptides (e.g., vancomycin), and tetracyclines. In addition, it was found that non-pathogenic commensals can harbor antibiotic resistance genes, and treatment results in a decrease in the abundance of antibiotic resistance genes in non-pathogenic commensal organisms. Without committing to any particular theory, these data support a method of decreasing the presence of antibiotic resistance genes by, at least in part, a mechanism of decreasing horizontal transfer of antibiotic resistance genes from non-pathogenic commensal organisms to pathogenic bacteria. Such a mechanism could be related at least in part to decreasing the abundance of bacteria harboring antibiotic resistance genes by outcompeting these bacteria for nutrients; decreasing the abundance of bacteria harboring antibiotic resistance genes by inducing a response in the host that limits the growth of potential pathogens harboring AbxR genes; decreasing the abundance of bacteria harboring antibiotic resistance genes by introducing bacteria that are directly antagonistic to potential pathogens harboring AbxR genes; reducing opportunistic pathogens, and/or decreasing the potential for the spread of antibiotic resistance genes between antibiotic resistant and susceptible organisms. In some embodiments, the decrease in the presence of antibiotic resistance genes occurs by reducing colonization in the host of microbes that harbor AbxR genes.

In some embodiments, a ROAR composition is used to break or prevent an antibiotic resistance transmission cycle. In such methods, a ROAR composition can be administered to a subject entering an environment in which there is a risk of an antibiotic resistance cycle or an environment in which the existence of an antibiotic resistance cycle has been identified, e.g., an environment in which antibiotic resistance has been identified as spreading or in which there is a risk of such spreading. Examples of such environments include hospitals, intensive care units, nursing homes, rehabilitation centers, group homes, and the like. In some embodiments, the dosing in such an environment is chronic. In some embodiments, a subject is treated to prevent or reduce colonization by one or more AbxR genes. In a subject that harbors one or more AbxR genes, a composition can be administered, thereby reducing the risk of AbxR infection in that subject and reducing the risk that subject will transmit AbxR genes after treatment of *C. difficile* disease, as such subjects may be susceptible to infection with or harbor antibiotic resistant bacteria. In some embodiments, a composition is administered to workers in environments in which there is a particular risk associated with spreading AbxR genes.

In some environments, "selective decontamination" of patients has been recommended, for example, in hospitals (particularly intensive care units) and nursing homes (for example, see Silvestri and van Saene, "Selective decontamination of the digestive tract: an update of the evidence," HSR Proc. Intensive Care Cardiovasc. Anesth. 4:21-29, 2012; Oostdijk et al., "Selective decontamination in European intensive care patients," Intensive Care Med. 38:533-538, 2012). A ROAR composition can be a useful alternative or supplement to such selective decontamination, adding to the armamentarium of methods available to decrease the presence of antibiotic resistance genes in these and other settings.

ROAR Compositions

ROAR compositions generally comprise *Firmicutes*. In some embodiments, the *Firmicutes* are capable of forming spores (spore-formers). Bacteria in a composition can be in the form of spores, mixed vegetative and spore forms, or vegetative form. In some cases, a composition consists of *Firmicutes*. In some embodiments, a ROAR composition comprises one or more species of *Bacteroidetes*. In some embodiments, a ROAR composition consists of at least one species from each of *Firmicutes* and *Bacteroidetes*. Compositions comprising or consisting of *Firmicutes* (or *Firmicutes* and *Bacteroidetes*) as the sole bacterial species of the compositions are not naturally occurring.

As a non-limiting example, a ROAR composition can be prepared from bacteria that are isolated from stool, e.g., human stool. In general, the stool is from a healthy animal (e.g., a human) of the same species as the animal to be treated. Bacteria can be prepared, for example, in a method using an amount of ethanol suitable to kill any non-spore form bacteria present in the stool. An example of such a preparation can be found in, for example, WO 2014/121302.

In some embodiments, a ROAR composition comprises or consists of selected bacterial species associated with a decrease in the abundance of antibiotic resistance genes in a subject (see, e.g., Table 3, below). Such compositions are referred to herein as "designed Abx compositions." The number of species (e.g., from Table 3) in a designed composition can be, for example, 1, 2, 3, 4, 5, 6, 7, 8, 9, 10, 11, 12, 13, 14, 15, 16, 17, 18, 19, 20, or more. In some embodiments the number of species is at least one and less than or equal to 50, for example, less than 45, less than 40, less than 35, less than 30, less than 25, less than 20, less than 15, less than 10, or less than 5. In some embodiments, the species selected from Table 3 do not include species that are also listed in Table 4.

Individual species in a designed ROAR composition may be cultured separately and then combined to create the composition. In some embodiments, a ROAR composition is produced by co-culturing all or subsets of the composition and then combining the components that were not co-cultured to create the composition. In some embodiments, a ROAR composition is produced by culturing a spore fraction derived from feces of a healthy human. The resulting culture can be used as a ROAR composition.

In some embodiments, the species selected for inclusion in a ROAR composition are associated with a decrease in the abundance of a particular class of antibiotic resistance genes, e.g., genes associated with resistance to quinolones, beta-lactams, and/or carbapenems (also see Table 2). In specific examples of, e.g., the compositions described above, bacterial species in a ROAR composition (e.g., designed Abx compositions) are selected from Table 2, and optionally may be identified by analysis of 16S rDNA sequences (or fragments thereof, e.g., a fragment comprising the 16S rDNA V4 and/or V6 regions; also see below and Table 5 for exemplary sequences).

In some embodiments, a species useful in a ROAR composition is a species having a full-length 16S rDNA with at least 95% sequence identity ("identity") (e.g., at least 96%, 97%, 98%, or 99%, or 100%) to the 16S rDNA of a reference species, e.g., a species identified in Table 3 (see, e.g., Table 5 for sequence information). In some embodiments, a species useful in a ROAR composition is a species having a full-length 16S rDNA with at least 97% sequence identity ("identity") to the 16S rDNA of a reference species, e.g., a species in Table 3 (see, e.g., Table 5 for sequence information). In some embodiments, a useful species has a V4 and/or V6 region 16S rDNA sequence having at least 95% identity (e.g., at least 96%, 97%, 98%, or 99%, or 100%) to a V4 and/or V6 region of 16S rDNA sequence of a reference species, e.g., a species identified in Table 3 (see, e.g., Table 5 for sequence information). In some embodiments, a useful species has a V4 and/or V6 region 16S rDNA sequence having at least 97% identity to a V4 and/or V6 region of 16S rDNA sequence of a reference species, e.g., a species identified in Table 3 (see, e.g., Table 5 for sequence information). In some embodiments, a useful species has a genomic sequence having at least 95% identity (e.g., at least 96%, 97%, 98%, or 99%, or 100%) to the full-length genomic DNA of a reference species, e.g., a species identified in Table 3. In some embodiments a useful species has a genomic sequence having at least 97% identity to the full-length genomic sequence of a reference species, e.g., a species identified in Table 3. In the event that a sequence is not provided herein, e.g., a 16S rDNA, V4, or V6 sequence, methods are well known in the art for identifying such sequences. Table 5 provides non-limiting examples of full-length 16S rDNA sequences that can be used as reference sequences. In general, identity or percent identity with a reference species means identity or percent identity with at least one 16S rDNA sequence (or fragment; e.g., V4 and/or V6) found in an organism.

In some cases, strains of bacterial species useful in the invention, e.g., species disclosed herein, can be obtained from a public biological resource center such as the ATCC (atcc.org), the DSMZ (dsmz.de), or the Riken BioResource Center (en.brc.riken.jp). 16s rDNA sequences useful for identifying species or other aspects of the invention can be obtained from public databases, e.g., the Human Microbiome Project (HMP) web site or GenBank.

Methods of determining sequence identity are known in the art and examples are provided infra.

In some embodiments, species excluded from ROAR compositions are species that are positively correlated with the presence of a particular class of antibiotic resistance genes (see, e.g., Table 4). These species can be identified using methods such as those described above (also see Table 6 for corresponding sequence information).

It is to be understood that "consisting of" in these examples refers to bacteria types that are present in a composition. A bacterial formulation "consisting of" listed species may thus contain additional non-bacterial materials such as one or more excipients (including, for example, one or more capsules), an aqueous or non-aqueous medium (e.g., glycerol, polyethylene glycol, cocoa butter, water, and/or a buffer), and/or one or more prebiotics or small molecule drugs.

Species/Naming Information

Names and classification of bacteria are subject to changes that may not be reflected in the literature. For convenience, alternate names for some bacterial species may be provided herein but are not intended to be a comprehensive set of alternative names. In some embodiments, species are identified by sequence identity of all or a portion (e.g., V4 or V6 regions) of a 16S rDNA sequence, e.g., at least 90%, 93% 95%, 96%, 97%, 98%, 99%, or 100% identity.

Determination of Identity

Clades, operational taxonomic units (OTUs), species, and strains are, in some embodiments, identified by their 16S rDNA sequence. The relatedness of clades, OTUs, species, and strains can be determined by the percent identity between clades, OTUs, species, or strains. Percent identity between a reference and query sequence can be determined using methods known in the art. Non-limiting examples of methods for such determinations are provided below. As used herein, the relatedness between two nucleotide sequences is described by the parameter "identity."

In one embodiment, the degree of sequence identity between a query sequence and a reference sequence is determined by (1) aligning the two sequences by any suitable alignment program using the default scoring matrix and default gap penalty, (2) identifying the number of exact matches, where an exact match is where the alignment program has identified an identical nucleotide in the two aligned sequences on a given position in the alignment, and (3) dividing the number of exact matches with the length of the reference sequence.

In another embodiment, the degree of sequence identity between a query sequence and a reference sequence is determined by (1) aligning the two sequences by any suitable alignment program using the default scoring matrix and default gap penalty, (2) identifying the number of exact matches, where an exact match is where the alignment program has identified an identical nucleotide in the two aligned sequences on a given position in the alignment, and (3) dividing the number of exact matches with the length of the longest of the two sequences.

In another embodiment, the degree of sequence identity between the query sequence and the reference sequence is determined by (1) aligning the two sequences by any suitable alignment program using the default scoring matrix and default gap penalty, (2) identifying the number of exact matches, where an exact match is where the alignment program has identified an identical amino acid or nucleotide in the two aligned sequences on a given position in the alignment, and (3) dividing the number of exact matches with the "alignment length," where the alignment length is the length of the entire alignment including gaps and overhanging parts of the sequences.

Sequence identity comparisons are carried out, generally, with the aid of a sequence comparison program. These commercially or publicly available computer programs use complex comparison algorithms to align two or more sequences that best reflect the evolutionary events that might have led to the difference(s) between the two or more sequences. Therefore, these algorithms operate with a scoring system rewarding alignment of identical or similar amino acids and penalizing the insertion of gaps, gap extensions, and alignment of non-similar amino acids. The scoring system of the comparison algorithms include:

i) assignment of a penalty score each time a gap is inserted (gap penalty score), ii) assignment of a penalty score each time an existing gap is extended with an extra position (extension penalty score), iii) assignment of high scores upon alignment of identical amino acids, and iv) assignment of variable scores upon alignment of non-identical amino acids.

In general, the default values of the alignment program are used for sequence comparisons.

Suitable computer programs useful for determining identity include, for example, BLAST (blast.ncbi.nlm.nih.gov).

In an embodiment of the present invention, the alignment program optimizes the alignment over the full-length of selected sequences, e.g., full-length, V4, or V6 16S rDNA sequence. For example, the global alignment program is based on the Needleman-Wunsch algorithm (Needleman and Wunsch, J. Mol. Biol. 48: 443-453, 1970). Non-limiting examples of such programs are EMBOSS Needle and EMBOSS Stretcher programs, available at ebi.ac.uk/Tools/psa/.

In one embodiment, the sequences are aligned by a global alignment program and the sequence identity is calculated by identifying the number of exact matches identified by the program divided by the "alignment length," where the alignment length is the length of the entire alignment including gaps and overhanging parts of the sequences. In a further embodiment, the global alignment program uses the Needleman-Wunsch algorithm and the sequence identity is calculated by identifying the number of exact matches identified by the program divided by the "alignment length," where the alignment length is the length of the entire alignment including gaps and overhanging parts of the sequences.

In yet a further embodiment, the global alignment program is selected from the group consisting of EMBOSS Needle and EMBOSS stretcher and the sequence identity is calculated by identifying the number of exact matches identified by the program divided by the "alignment length," where the alignment length is the length of the entire alignment including gaps and overhanging parts of the sequences.

Once the software has produced an alignment, it is possible to calculate percent (%) similarity and percent sequence identity.

Methods of Testing Compositions for AbxR Activity or the Presence of AbxR Genes

A ROAR composition can be tested for the ability to reduce the abundance of antibiotic resistance genes in the GI tract of an animal using in vitro and/or in vivo models known in the art (for example, see Schjørring and Krogfelt, Int. J. Microbiol. 2011:312956, 2011; Marra, "Animal models in drug development for MRSA," Meth. Mol. Biol. 1085:333-345, 2014). Such models can be adapted for use in testing candidate ROAR compositions. Additional examples of suitable models are described in the Examples. In addition, a ROAR composition can be tested for the ability to reduce the abundance of AbxR genes in human subjects enrolled in clinical trials.

Subjects

In some embodiments, a subject suitable for treatment with a composition disclosed herein (a ROAR composition) is an animal, e.g., a mammal such as a human, dog, cat, bovine, ovine, coprine, equine, or other farm, domestic, or zoo animal at risk for, or diagnosed with, having an undesirable level of AbxR microorganisms, e.g., in at least a portion of the gastrointestinal (GI) tract. An undesirable level of AbxR organisms can be identified as a level significantly greater than that in a healthy population, for example, in the context of treating humans, the healthy population documented in the Human Microbiome Project database. Such organisms can be detected by, for example, culturing a stool or other gastrointestinal sample from the subject and using known methods of testing for the presence of antibiotic resistance. The methods include, for example, dilution methods (broth and agar dilution methods), disk-diffusion methods, E-test, automated methods, mechanism-specific tests such as beta-lactamase detection test and chromogenic cephalosporin tests, and genotypic methods such as PCR and DNA hybridization methods. Such methods also include the identification and quantification of antibiotic resistance associated genes by whole metagenomics shotgun (WMS) sequencing. In some embodiments, an undesirable level of AbxR organisms or genes can be identified using molecular methods that identify the presence or absence of genes, gene cassettes, or genetic markers associated with the phenotype of AbxR. Some examples of such molecular methods include but are not limited to DNA sequencing, transcriptional profiling, and methods that utilize a molecular probe.

In some embodiments, a subject suitable for treatment with a ROAR composition is or has been unresponsive to treatment with one or more antibiotics and the presence of an antibiotic resistant microbial population is inferred.

In some embodiments, a subject suitable for treatment with a ROAR composition has or is at risk of developing *C. difficile* infection or disease. In some embodiments, a subject suitable for treatment with a ROAR composition has or is at risk of developing a colitis (e.g., Crohn's disease or ulcerative colitis (e.g., mild to moderate ulcerative colitis)).

Advantages

Use of conventional antibiotics, in addition to the potential for the existence or development of antibiotic resistance by a subject's microbiome, can cause serious side effects including, for example, GI effects such as dysbiosis, overgrowth of pathogens, nervous system damage, and allergic reactions. A ROAR composition typically comprises commensal bacteria and has limited side effects, e.g., is well-tolerated by subjects receiving the treatment. A ROAR composition can be administered repeatedly over time, as needed, and may reduce the risk of developing antibiotic resistance to a large group of antibiotics, e.g., by reducing the prevalence of antibiotic resistance genes in a treated individual. In general, a ROAR composition can modulate transmission cycles in which bacteria transmit antibiotic resistance genes. This feature is useful in, for example, health care settings in which the use of the compositions decreases the risk of fragile patients being exposed to or developing antibiotic resistance, both individually and as a patient population.

In some embodiments, an additional advantage of an ROAR composition that administration of the composition may improve the integrity of the epithelial and mucosal barriers, for example, by reducing the amount of local inflammation, and reducing the risk of translocation and infection by GI local microbes.

Definitions

"Augmentation" of a type of bacterium, e.g., a species, is an effect of treatment with a composition of the invention that is characterized by post-treatment detection of an increased abundance of a species not present in the composition by a nonparametric test of abundance.

"Engraftment" of a type of bacterium, e.g., a species, is an effect of treatment with a composition of the invention that is characterized by post-treatment detection of a species from the administered composition, which is not detected in the treated subject pretreatment. Methods of detection are known in the art. In one example, the method is PCR detection of a 16S rDNA sequence using standard parameters for PCR.

"Operational taxonomic unit," "OTU" (or plural, "OTUs") refers to a terminal leaf in a phylogenetic tree and is defined by a nucleic acid sequence, e.g., the entire genome, or a specific genetic sequence, and all sequences that share sequence identity to this nucleic acid sequence at the level of species. In some embodiments the specific genetic sequence is the 16S sequence or a portion of the 16S sequence, such as a variable region, e.g., a V4 region. In other embodiments, the entire genomes of two entities are sequenced and compared. In another embodiment, select regions such as multilocus sequence tags (MLST), specific genes, or sets of genes may be genetically compared. In 16S embodiments, OTUs that share ≥97% average nucleotide identity across an entire 16S or a variable region of a 16S sequence are considered the same OTU (see e.g., Claesson et al., Nucleic Acids Res. 38:e200, 2010; Konstantinidis et al., Philos. Trans. R. Soc. Lond. B. Biol. Sci. 361:1929-1940, 2006). In embodiments involving the complete genome, MLSTs, specific genes, or sets of genes, OTUs that share ≥95% average nucleotide identity are considered the same OTU (see e.g. Achtman and Wagner, Nat. Rev. Microbiol. 6:431-440, 2008). OTUs can be distinguished, in some embodiments, by comparing sequences between organisms. Generally, sequences with less than 95% sequence identity are not considered to form part of the same OTU. OTUs may also be characterized by any combination of nucleotide markers or genes, in particular highly conserved genes (e.g., "house-keeping" genes), or a combination thereof. Such characterization employs, e.g., WGS data or a whole genome sequence. As used herein, the terms "species" and "OTU" are used interchangeably unless otherwise distinguished by context.

A "therapeutically effective amount" of a composition described herein can vary according to factors such as the disease state, age, sex, and weight of the individual, and the ability of the composition to elicit a desired response in the individual, e.g., amelioration of at least one disorder parameter, or amelioration of at least one symptom of the disorder (and optionally, the effect of any additional agents being administered). A therapeutically effective amount is also one in which any toxic or detrimental effects of the composition are outweighed by the therapeutically beneficial effects. A composition as described herein is generally administered in a therapeutically effective amount.

Formulations

ROAR compositions (e.g., designed Abx compositions) described herein can be prepared and administered using methods known in the art. In general, compositions are formulated for oral, colonoscopic, or nasogastric delivery although any appropriate method can be used.

A ROAR formulation can contain one or more pharmaceutical excipients suitable for the preparation or delivery of such formulations. In some embodiments, the formulation is a liquid formulation. In some embodiments, a formulation comprising a ROAR composition can comprise one or more of surfactants, adjuvants, buffers, antioxidants, tonicity adjusters, thickeners, viscosity modifiers, and the like.

In some embodiments, treatment includes administering a ROAR composition in a formulation that includes a pharmaceutically acceptable carrier. In some embodiments, the excipient includes a capsule or other format suitable for providing the ROAR composition as an oral dosage form. When an excipient serves as a diluent, it can be a solid, semi-solid, or liquid material, which acts as a vehicle, carrier, or medium for the active ingredient. Thus, the formulations can be in the form of tablets, pills, powders, lozenges, sachets, cachets, elixirs, suspensions, emulsions, solutions, syrups, soft or hard capsules, suppositories, or packaged powders.

Some examples of suitable excipients include lactose, dextrose, sucrose, sorbitol, mannitol, starches, gum acacia, calcium phosphate, alginates, tragacanth, gelatin, calcium silicate, microcrystalline cellulose, polyvinylpyrrolidone, cellulose, water, syrup, polyethylene glycol, glycerol, and methyl cellulose. The compositions can be formulated so as to provide quick, sustained, or delayed release of the active ingredient after administration to the patient by employing procedures known in the art.

A ROAR composition can be formulated in a unit dosage form. In general, a dosage comprises about 10e2 to 10e9 viable colony forming units (cfu). In some embodiments, the ROAR compositions comprises or is composed of spore-former bacteria in spore form. In such cases, the dosage may be determined as "spore CFU" or "sCFU", which quantify the number of viable spores by germination and growth, typically on plates.

The term "unit dosage forms" refers to physically discrete units suitable as unitary dosages for human subjects and/or other mammals, each unit containing a predetermined quantity of active material calculated to produce a desired therapeutic effect, in association with a suitable pharmaceutical excipient. A dosage may be administered in multiple delivery vehicles, e.g., multiple pills or capsules.

The amount and frequency of administering a ROAR composition to a patient will vary depending upon what is being administered, the purpose of the administration, such as prophylaxis or therapy, the state of the patient, the manner of administration, and the like. In therapeutic applications, compositions can be administered to a patient already suffering from a disease in an amount sufficient to cure or at least partially arrest one or more symptoms of the disease or its complications. Effective doses will depend on the disease or condition being treated, as well as by the judgment of the attending clinician, depending upon factors such as the severity of the disease, the age, weight, and general condition of the patient, and the like.

The dosage can refer, for example, to the total number of cfus of each individual species or strains, or can refer to the total number of microorganisms in the dose. It is understood in the art that determining the number of organisms in a dosage is not exact and can depend on the method used to determine the number of organisms present. For example, the number of spores in a composition may be determined using a dipicolinic acid assay. In some cases, the number of organisms may be determined using a culture assay. When spores are present, the ability of assays relying on culture methods can depend on efficient germination of spores. Quantitative nucleic acid-based methods can depend on whether the nucleic acids from non-viable microorganisms are sufficiently reduced or eliminated. Effective doses can be extrapolated from dose-response curves derived from in vitro or animal model test systems.

Screening Methods

The invention also provides methods for identifying bacterial compositions that can be used to decrease the abundance of antibiotic resistance genes in subjects. In these methods, candidate compositions are analyzed for the presence of one or more bacterial species of Table 3. Detection of one or more (e.g., 2, 3, 4, 5, 6, 7, 8, 9, 10, 11, 12, 13, 14, 15, 16, 17, 18, 19, 20, or more) of these species indicates that the composition may be useful in decreasing the abundance of antibiotic resistance genes. Additional testing can be done to further screen candidate compositions. For example, candidate compositions can further be analyzed for the presence of one or more species of Table 4. In some embodiments, it may be determined that it is preferable to avoid use of compositions identified as including one or more (e.g., 2, 3, 4, 5, 6, 7, 8, 9, 10, 11, 12, 13, 14, 15, 16, 17, 18, 19, 20, or more) species of Table 4.

In other screening methods of the invention, potential donors of feces for use in therapeutic methods (e.g., therapeutic methods of the present invention) are screened for their suitability to serve as donors. In these methods, a fecal sample of a potential donor is screened for the presence of one or more bacterial species associated with decreased antibiotic resistance genes (see, e.g., Table 3; see Table 5 for sequences) and/or one or more bacterial species correlated with the presence of antibiotic resistance genes (see, e.g., Table 4; see Table 6 for sequences). Detection of the former may indicate that the potential donor is suitable to proceed to serve as a donor, while detection of the latter may indicate that the potential donor should not proceed, as can be determined by those of skill in the art.

Additional screening methods include those used to determine whether a subject may benefit from treatment with a ROAR composition, as described herein. In these methods, a sample from the subject (e.g., a fecal sample) is tested for the presence of one or more bacterial species correlated with the presence of antibiotic resistance genes (see, e.g., Tables 4 and 6). Detection of one or more of these species can indicate that the subject may benefit from treatment according to the therapeutic methods of the invention, as can be determined by those of skill in the art.

Detection of species in these methods of the invention can be carried out using methods that are known in the art (see, e.g., above and elsewhere herein). For example, methods including, for example, qPCR, whole metagenomics shotgun sequencing (WMS; see, e.g., below), and/or analysis of 16S rDNA sequences or a portion thereof (e.g., the V4 and/or V6 regions; see, e.g., Table 5) can be performed. Sequences from Table 5 can be detected with respect to the identification of negative correlates (i.e., reduction in antibiotic resistance genes). Sequences from Table 6 can be detected with respect to the identification of positive correlates (i.e., increased abundance of antibiotic resistance genes).

EQUIVALENTS

All technical features can be individually combined in all possible combinations of such features.

The invention may be embodied in other specific forms without departing from the spirit or essential characteristics thereof. The foregoing embodiments are therefore to be considered in all respects illustrative rather than limiting on the invention described herein.

EXAMPLES

The following non-limiting examples further illustrate embodiments of the inventions described herein.

Example 1: Human Studies—*Clostridium difficile*

Human subjects at risk for recurrent *Clostridium difficile* infection (rCDI) were treated with enriched and purified spores prepared from the stool of healthy, screened humans in a randomized, double-blind, placebo-controlled Phase 2 trial (n=89; randomized 2:1; 36 sites). The spores were administered orally in a single dose (of 4 capsules). Dosing was at 10e8 spore equivalents. The GI microbiomes of these subjects, as well as subjects in a Phase 1b open label dose ranging study, were profiled using whole metagenomics shotgun sequencing (WMS). Stool samples were collected before treatment with the spores (after treatment with antibiotics) and after receiving spores or placebo, as applicable.

DNA was extracted from stool samples and used to generate WMS data with the Illumina sequencing platform. WMS data was screened for the presence and abundance of genetic markers of proteins known to confer antibiotics resistance, as catalogued in the Comprehensive Antibiotic Resistance Database (CARD v.1.1.8) (card.mcmaster.ca). Genetic markers associated with these proteins were constructed using ShortBRED (Kaminski et al., PLoS Comput Biol 11(12):e1004557), an informatics tool designed to identify proteins of interest at high specificity within WMS data (Table 1). For each class of antibiotics, the abundance of genetic markers associated with resistance to that class summed to generate normalized-gene abundance values (referred to herein as drug class marker-abundance or DCMA).

Figure 2:
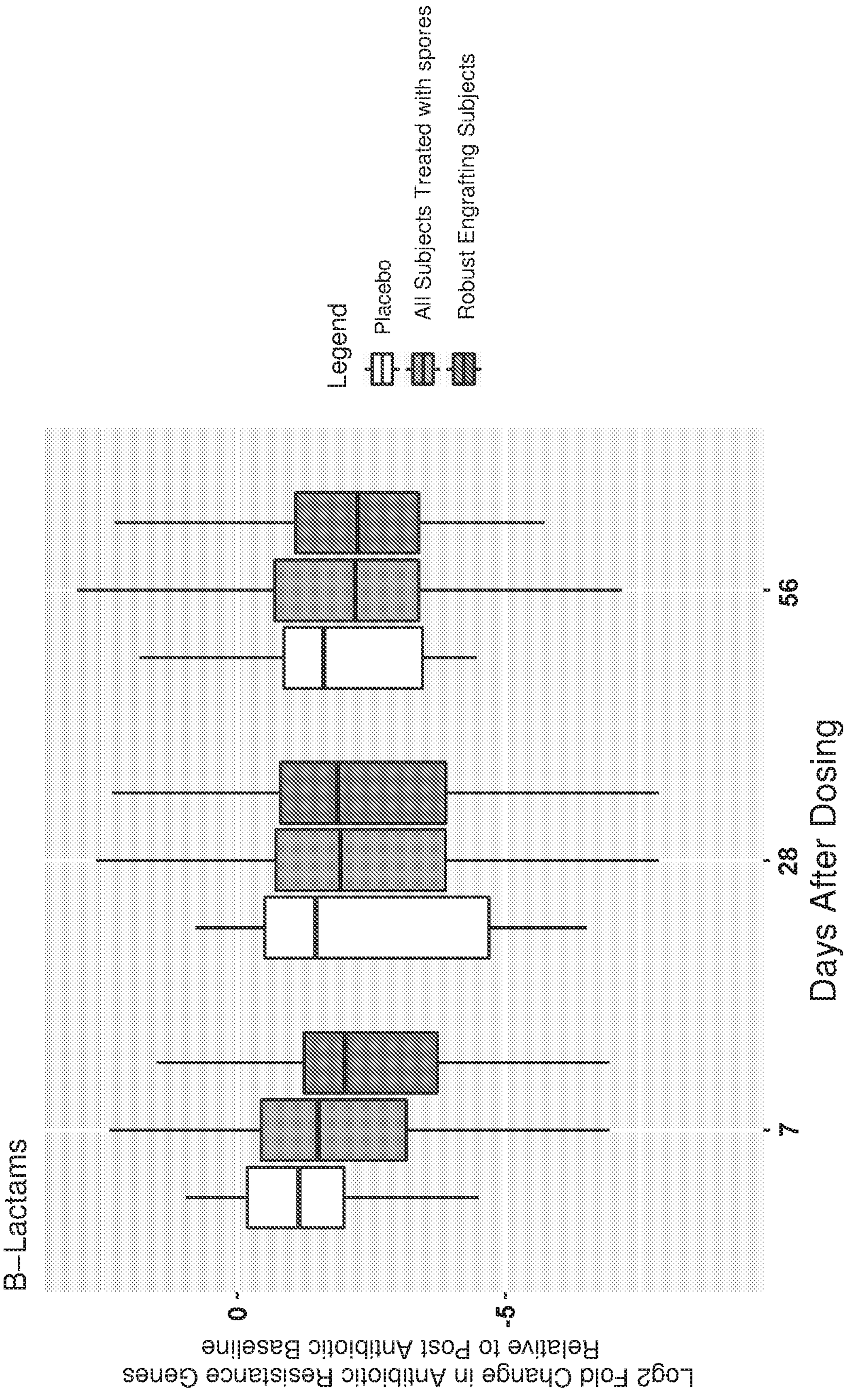
FIG. 2 is a graph depicting the results of an experiment detecting the reduction of genes associated with beta-lactam antibiotic resistance in human subjects 7, 28, and 56 days after dosing with a human commensal spore composition. White=subjects who received placebo, medium gray=all subjects treated with the spore composition, dark gray=results from the subset of subjects with a significant engraftment signal.

For the Phase 2 study, differential prevalence of spore-former species was observed based on WMS analysis. Gene abundance was assessed using the ShortBRED markers (Kaminski et al., supra) for genes associated with antibiotic resistance identified in ARDB (Liu and Pop, 2009, ARDB—Antibiotic Resistance Genes Database. Nuc Acids Res 37(Database issue):D443-447). Data were analyzed for a significant engraftment signal, defined as subjects in whom a significant number of species were identified as being significantly genetically similar to species identified in the administered ROAR composition. Analysis of the data resulted in the discovery that in subjects with a significant engraftment signal for the composition, the abundance of genes associated with resistance to multiple classes of drugs, i.e., quinolone drugs (FIG. 1) and beta-lactam or carbapenem drugs (FIG. 2), was reduced.

In additional analyses, for each subject and drug class (from both the Phase 1b and Phase 2 studies), we calculated the log 2 fold change (log 2FC) of drug class marker abundance (DCMA) between samples collected at the visit 1 week after receiving placebo or spores, as compared to samples collected one day prior to treatment with placebo or spores. We compared rCDI subjects who received placebo to rCDI subjects who received spores and in whom significant engraftment was detected. We used the non-parametric Mann-Whitney test to determine if the log 2FC in DCMA was significantly greater in subjects with engraftment of spores as compared to subjects who received placebo (Table 2). False discovery rates (FDR), the expected proportion of incorrectly rejected null hypotheses for a given p-value due to running multiple tests, was calculated using the Benjamini-Hochberg procedure ($p<0.1$)

The data demonstrate that a ROAR composition can be used to reduce the abundance of antibiotic resistance genes in a subject.

TABLE 1

Change in abundance of genes in response to treatment

| CARD accession | p-value | FDR | log2 Engrafters - log2 Placebo | Gene Symbol |
|---|---|---|---|---|
| ARO_3000753 | 1.5E−03 | 8.5E−02 | 0.91 | abeM |
| ARO_3000216 | 2.9E−03 | 8.5E−02 | −1.24 | acrB |
| ARO_3000828 | 2.5E−03 | 8.5E−02 | −1.38 | baeR |
| ARO_3000830 | 1.3E−03 | 8.5E−02 | −1.57 | cpxA |
| ARO_3002867 | 2.7E−03 | 8.5E−02 | 1.35 | dfrF |
| ARO_3004039 | 3.7E−03 | 8.5E−02 | −1.27 | *Escherichia coli* emrE |
| ARO_3002522 | 2.4E−04 | 8.5E−02 | 0.90 | novA |
| ARO_3000196 | 1.1E−03 | 8.5E−02 | 1.72 | tet32 |
| ARO_3002871 | 2.2E−03 | 8.5E−02 | 1.46 | tet37 |
| ARO_3000195 | 7.4E−04 | 8.5E−02 | −1.28 | tetB(P) |
| ARO_3002829 | 3.0E−03 | 8.5E−02 | 0.70 | vgaA |
| ARO_3000499 | 5.1E−03 | 9.5E−02 | −1.47 | acrE |
| ARO_3002626 | 6.1E−03 | 9.5E−02 | −0.76 | ANT(6)-Ia |
| ARO_3003838 | 5.7E−03 | 9.5E−02 | −1.50 | gadW |
| ARO_3002836 | 5.6E−03 | 9.5E−02 | −0.50 | InuB |
| ARO_3000263 | 6.7E−03 | 9.5E−02 | −1.33 | marA |
| ARO_3000793 | 6.3E−03 | 9.5E−02 | −1.40 | mdtB |
| ARO_3000794 | 6.7E−03 | 9.5E−02 | −1.59 | mdtC |
| ARO_3000180 | 4.9E−03 | 9.5E−02 | −0.53 | tetA(P) |
| ARO_3000194 | 5.1E−03 | 9.5E−02 | 1.57 | tetW |
| ARO_3003202 | 5.4E−03 | 9.5E−02 | −0.30 | TLA-1 |
| ARO_3000796 | 7.4E−03 | 1.0E−01 | −1.65 | mdtF |
| ARO_3000615 | 8.5E−03 | 1.1E−01 | −1.41 | mefA |
| ARO_3002818 | 8.3E−03 | 1.1E−01 | −1.24 | msrB |
| ARO_3000024 | 9.0E−03 | 1.1E−01 | −1.02 | patA |
| ARO_3000829 | 1.0E−02 | 1.2E−01 | −1.47 | baeS |
| ARO_3000491 | 1.1E−02 | 1.2E−01 | −1.11 | acrD |
| ARO_3000656 | 1.3E−02 | 1.2E−01 | −1.17 | acrS |
| ARO_3000074 | 1.1E−02 | 1.2E−01 | −1.10 | emrB |
| ARO_3000309 | 1.2E−02 | 1.2E−01 | −1.33 | emrD |
| ARO_3000206 | 1.5E−02 | 1.2E−01 | −1.15 | emrK |
| ARO_3000254 | 1.4E−02 | 1.2E−01 | −1.42 | emrY |
| ARO_3000833 | 1.3E−02 | 1.2E−01 | −1.20 | evgS |
| ARO_3000795 | 1.3E−02 | 1.2E−01 | −1.31 | mdtE |
| ARO_3003550 | 1.4E−02 | 1.2E−01 | −1.20 | mdtP |
| ARO_3003950 | 1.3E−02 | 1.2E−01 | −1.48 | msbA |
| ARO_3003952 | 1.4E−02 | 1.2E−01 | −1.12 | yojI |
| ARO_3003549 | 1.5E−02 | 1.3E−01 | −1.14 | mdtO |
| ARO_3002630 | 1.8E−02 | 1.3E−01 | −0.41 | ANT(9)-Ia |
| ARO_3002634 | 1.9E−02 | 1.3E−01 | −1.04 | APH(2")-Ie |
| ARO_3001328 | 1.9E−02 | 1.3E−01 | −1.02 | *Escherichia coli* mdfA |
| ARO_3000832 | 1.8E−02 | 1.3E−01 | −1.18 | evgA |
| ARO_3000676 | 1.7E−02 | 1.3E−01 | −1.08 | H-NS |
| ARO_3003206 | 1.8E−02 | 1.3E−01 | −0.40 | IsaE |

TABLE 1-continued

Change in abundance of genes in response to treatment

| CARD accession | p-value | FDR | log2 Engrafters - log2 Placebo | Gene Symbol |
|---|---|---|---|---|
| ARO_3001329 | 2.0E−02 | 1.3E−01 | −1.05 | mdtG |
| ARO_3001216 | 1.8E−02 | 1.3E−01 | −1.12 | mdtH |
| ARO_3003107 | 1.8E−02 | 1.3E−01 | −0.20 | mefB |
| ARO_3002174 | 2.0E−02 | 1.3E−01 | −1.21 | MIR-9 |
| ARO_3000237 | 1.9E−02 | 1.3E−01 | −1.11 | tolC |
| ARO_3000502 | 2.4E−02 | 1.4E−01 | −0.91 | acrF |
| ARO_3002986 | 2.4E−02 | 1.4E−01 | −1.33 | bacA |
| ARO_3002669 | 2.9E−02 | 1.5E−01 | −0.90 | APH(2")-Ig |
| ARO_3002152 | 2.9E−02 | 1.5E−01 | −1.25 | DHA-21 |
| ARO_3000516 | 2.9E−02 | 1.5E−01 | −1.23 | emrR |
| ARO_3002985 | 3.2E−02 | 1.7E−01 | −0.84 | arnA |
| ARO_3003057 | 3.4E−02 | 1.7E−01 | −0.23 | smeF |
| ARO_3000803 | 3.4E−02 | 1.7E−01 | −0.18 | MexE |
| ARO_3001304 | 3.5E−02 | 1.7E−01 | −0.49 | ErmS |
| ARO_3002559 | 3.6E−02 | 1.7E−01 | −1.06 | AAC(6')-Ip |
| ARO_3003017 | 3.7E−02 | 1.7E−01 | −0.09 | dfrA21 |
| ARO_3002804 | 3.7E−02 | 1.7E−01 | −0.37 | FosA2 |
| ARO_3002894 | 3.7E−02 | 1.7E−01 | −0.06 | otrC |
| ARO_3003576 | 3.7E−02 | 1.7E−01 | −0.89 | PmrC |
| ARO_3003841 | 3.8E−02 | 1.7E−01 | −0.84 | kdpE |
| ARO_3003578 | 4.0E−02 | 1.8E−01 | −0.87 | pmrF |
| ARO_3002597 | 4.4E−02 | 2.0E−01 | −0.93 | AAC(6')-Ie-APH(2")-II |
| ARO_3002635 | 4.4E−02 | 2.0E−01 | −1.22 | APH(2")-IIa |
| ARO_3000205 | 4.8E−02 | 2.1E−01 | −1.14 | tetX |
| ARO_3000192 | 4.9E−02 | 2.1E−01 | −0.15 | tetS |
| ARO_3004042 | 5.0E−02 | 2.1E−01 | −1.14 | *Enterobacter cloacae* acrA |
| ARO_3003773 | 5.6E−02 | 2.3E−01 | −0.04 | *Clostridium perfringens* mprF |
| ARO_3002859 | 5.6E−02 | 2.3E−01 | 0.23 | dfrA14 |
| ARO_3003548 | 5.5E−02 | 2.3E−01 | −0.87 | mdtN |
| ARO_3002688 | 5.8E−02 | 2.3E−01 | 0.21 | catS |
| ARO_3002835 | 5.8E−02 | 2.3E−01 | −0.21 | InuA |
| ARO_3000518 | 6.1E−02 | 2.3E−01 | −0.99 | CRP |
| ARO_3000792 | 6.2E−02 | 2.3E−01 | −0.60 | mdtA |
| ARO_3000826 | 6.1E−02 | 2.3E−01 | −0.90 | sdiA |
| ARO_3002671 | 6.3E−02 | 2.3E−01 | −0.32 | cat-TC |
| ARO_3003112 | 6.3E−02 | 2.3E−01 | 0.11 | IsaC |
| ARO_3002670 | 6.9E−02 | 2.5E−01 | 0.70 | cat |
| ARO_3000508 | 6.9E−02 | 2.5E−01 | −0.81 | gadX |
| ARO_3000300 | 7.0E−02 | 2.5E−01 | −0.22 | IsaA |
| ARO_3003699 | 7.0E−02 | 2.5E−01 | −0.25 | mexQ |
| ARO_3000191 | 6.8E−02 | 2.5E−01 | −1.21 | tetQ |
| ARO_3000027 | 7.2E−02 | 2.5E−01 | −0.76 | emrA |
| ARO_3000377 | 7.5E−02 | 2.6E−01 | −0.25 | MexA |
| ARO_3003704 | 8.0E−02 | 2.6E−01 | −0.10 | mexM |
| ARO_3003705 | 8.0E−02 | 2.6E−01 | −0.24 | mexN |
| ARO_3001421 | 7.8E−02 | 2.6E−01 | 0.03 | OXA-26 |
| ARO_3002639 | 8.3E−02 | 2.6E−01 | −0.51 | APH(3")-Ib |
| ARO_3004072 | 8.5E−02 | 2.6E−01 | −0.22 | OpmB |
| ARO_3003681 | 8.5E−02 | 2.6E−01 | −0.22 | TriC |
| ARO_3002932 | 8.3E−02 | 2.6E−01 | −0.30 | vanSB |
| ARO_3002831 | 8.4E−02 | 2.6E−01 | −1.15 | vgaC |
| ARO_3000250 | 8.9E−02 | 2.7E−01 | −0.27 | ErmC |
| ARO_3002964 | 8.9E−02 | 2.7E−01 | −0.35 | vanWB |
| ARO_3003679 | 9.0E−02 | 2.7E−01 | −0.13 | TriA |
| ARO_3002950 | 9.5E−02 | 2.8E−01 | −0.39 | vanXB |
| ARO_3002553 | 9.8E−02 | 2.9E−01 | −0.02 | AAC(6')-If |
| ARO_3001777 | 9.8E−02 | 2.9E−01 | −0.04 | OXA-347 |
| ARO_3001303 | 1.1E−01 | 3.0E−01 | 0.07 | ErmO |
| ARO_3000823 | 1.1E−01 | 3.0E−01 | −0.98 | ramA |
| ARO_3002933 | 1.1E−01 | 3.0E−01 | −0.12 | vanSC |
| ARO_3003031 | 1.1E−01 | 3.1E−01 | −0.34 | mexW |
| ARO_3002679 | 1.1E−01 | 3.1E−01 | −0.25 | catB7 |
| ARO_3000578 | 1.2E−01 | 3.4E−01 | −0.21 | CcrA beta-lactamase |
| ARO_3002156 | 1.2E−01 | 3.4E−01 | 0.16 | FOX-2 |
| ARO_3000811 | 1.2E−01 | 3.4E−01 | −0.04 | mtrD |
| ARO_3001299 | 1.2E−01 | 3.4E−01 | 0.02 | tIrB conferring tylosinr esistance |
| ARO_3002502 | 1.3E−01 | 3.4E−01 | −0.23 | PDC-5 |
| ARO_3000149 | 1.3E−01 | 3.5E−01 | −0.15 | fosA |
| ARO_3000378 | 1.4E−01 | 3.6E−01 | −0.29 | MexB |
| ARO_3002923 | 1.4E−01 | 3.6E−01 | −0.59 | van RD |

TABLE 1-continued

Change in abundance of genes in response to treatment

| CARD accession | p-value | FDR | log2 Engrafters - log2 Placebo | Gene Symbol |
|---|---|---|---|---|
| ARO_3003577 | 1.4E−01 | 3.7E−01 | −0.65 | pmrE |
| ARO_3003922 | 1.4E−01 | 3.7E−01 | −0.99 | oqxA |
| ARO_3000806 | 1.5E−01 | 3.7E−01 | −0.18 | mexG |
| ARO_3002629 | 1.5E−01 | 3.9E−01 | 0.74 | ANT(6)-Ib |
| ARO_3002868 | 1.6E−01 | 3.9E−01 | −0.25 | dfrG |
| ARO_3000379 | 1.6E−01 | 3.9E−01 | −0.14 | OprM |
| ARO_3002687 | 1.7E−01 | 4.0E−01 | −0.05 | catQ |
| ARO_3002858 | 1.7E−01 | 4.0E−01 | −0.03 | dfrA12 |
| ARO_3000347 | 1.7E−01 | 4.0E−01 | −0.28 | ErmA |
| ARO_3000807 | 1.6E−01 | 4.0E−01 | −0.26 | mexH |
| ARO_3000621 | 1.6E−01 | 4.0E−01 | 0.01 | PC1 beta-lactamase (blaZ) |
| ARO_3003046 | 1.7E−01 | 4.0E−01 | −0.03 | qacA |
| ARO_3002965 | 1.6E−01 | 4.0E−01 | −0.26 | vanWG |
| ARO_3002943 | 1.7E−01 | 4.0E−01 | 0.30 | vanHB |
| ARO_3000025 | 1.7E−01 | 4.0E−01 | 0.12 | patB |
| ARO_3004073 | 1.7E−01 | 4.0E−01 | −0.20 | MuxA |
| ARO_3000368 | 1.8E−01 | 4.0E−01 | −0.13 | vanC |
| ARO_3002970 | 1.8E−01 | 4.1E−01 | −0.11 | vanTC |
| ARO_3003698 | 1.8E−01 | 4.1E−01 | −0.21 | mexP |
| ARO_3003835 | 1.9E−01 | 4.2E−01 | −0.24 | cdeA |
| ARO_3004077 | 1.9E−01 | 4.2E−01 | −0.20 | PmpM |
| ARO_3003551 | 1.9E−01 | 4.3E−01 | −0.19 | emeA |
| ARO_3002528 | 2.0E−01 | 4.3E−01 | 0.02 | AAC(3)-Ia |
| ARO_3002578 | 2.0E−01 | 4.3E−01 | −0.24 | AAC(6')-Ib7 |
| ARO_3002686 | 2.0E−01 | 4.3E−01 | 0.15 | catP |
| ARO_3003693 | 2.0E−01 | 4.3E−01 | −0.19 | mexK |
| ARO_3002452 | 2.0E−01 | 4.3E−01 | −0.79 | OKP-B-19 |
| ARO_3002957 | 2.0E−01 | 4.3E−01 | −0.14 | vanYD |
| ARO_3002921 | 2.0E−01 | 4.4E−01 | −0.38 | van RB |
| ARO_3001338 | 2.1E−01 | 4.4E−01 | −0.57 | SHV-100 |
| ARO_3004056 | 2.2E−01 | 4.5E−01 | −0.10 | ArmR |
| ARO_3002317 | 2.2E−01 | 4.5E−01 | 0.00 | KPC-7 |
| ARO_3002391 | 2.1E−01 | 4.5E−01 | −0.94 | OXY-1-3 |
| ARO_3000567 | 2.1E−01 | 4.5E−01 | 0.97 | tet(40) |
| ARO_3002185 | 2.2E−01 | 4.5E−01 | −0.06 | MOX-6 |
| ARO_3002972 | 2.2E−01 | 4.5E−01 | −0.11 | vanTG |
| ARO_3001796 | 2.3E−01 | 4.6E−01 | −0.23 | OXA-50 |
| ARO_3002956 | 2.3E−01 | 4.6E−01 | −0.40 | vanYB |
| ARO_3002999 | 2.3E−01 | 4.7E−01 | 0.10 | CblA−1 |
| ARO_3004036 | 2.3E−01 | 4.7E−01 | 0.02 | tetB(60) |
| ARO_3000316 | 2.5E−01 | 5.0E−01 | 0.05 | mphA |
| ARO_3003923 | 2.5E−01 | 5.0E−01 | −0.89 | oqx6 |
| ARO_3002930 | 2.5E−01 | 5.0E−01 | 0.19 | van RO |
| ARO_3003022 | 2.9E−01 | 5.1E−01 | 0.01 | dfrB3 |
| ARO_3002705 | 2.9E−01 | 5.1E−01 | −0.01 | floR |
| ARO_3002213 | 2.9E−01 | 5.1E−01 | −0.01 | IMP-22 |
| ARO_3004041 | 2.9E−01 | 5.1E−01 | −0.48 | *Klebsiella pneumoniae* acrA |
| ARO_3002482 | 2.9E−01 | 5.1E−01 | −0.05 | LRA-1 |
| ARO_3002486 | 2.9E−01 | 5.1E−01 | 0.01 | LRA-7 |
| ARO_3001214 | 2.6E−01 | 5.1E−01 | −0.56 | mdtM |
| ARO_3000215 | 2.9E−01 | 5.1E−01 | 0.00 | mecR1 |
| ARO_3001610 | 2.9E−01 | 5.1E−01 | 0.01 | OXA-243 |
| ARO_3001503 | 2.9E−01 | 5.1E−01 | 0.03 | OXA-258 |
| ARO_3001780 | 2.7E−01 | 5.1E−01 | 0.08 | OXA-85 |
| ARO_3003836 | 2.9E−01 | 5.1E−01 | 0.01 | qacH |
| ARO_3002828 | 2.7E−01 | 5.1E−01 | −0.19 | srmB |
| ARO_3000573 | 2.9E−01 | 5.1E−01 | 0.02 | tet(43) |
| ARO_3000013 | 2.6E−01 | 5.1E−01 | −0.26 | van B |
| ARO_3003727 | 2.9E−01 | 5.1E−01 | 0.00 | vanKI |
| ARO_3003724 | 2.9E−01 | 5.1E−01 | −0.01 | vanW1 |
| ARO_3002841 | 2.9E−01 | 5.1E−01 | 0.01 | vatB |
| ARO_3004032 | 3.0E−01 | 5.2E−01 | 0.40 | tetA(46) |
| ARO_3003033 | 3.1E−01 | 5.4E−01 | −0.20 | mexY |
| ARO_3004033 | 3.1E−01 | 5.4E−01 | 0.36 | tetB(46) |
| ARO_3003209 | 3.2E−01 | 5.5E−01 | −0.60 | FosA5 |
| ARO_3002538 | 3.8E−01 | 5.5E−01 | 0.01 | AAC(3)-IIIc |
| ARO_3002540 | 3.8E−01 | 5.5E−01 | 0.00 | AAC(3)-Vla |
| ARO_3002589 | 3.8E−01 | 5.5E−01 | 0.04 | AAC(6')-Iid |
| ARO_3001816 | 3.4E−01 | 5.5E−01 | −0.24 | ACC-2 |
| ARO_3003848 | 3.8E−01 | 5.5E−01 | −0.02 | ADC-2 |
| ARO_3000780 | 3.8E−01 | 5.5E−01 | 0.02 | adeI |
| ARO_3002646 | 3.8E−01 | 5.5E−01 | 0.01 | APH(3')-IIc |
| ARO_3002660 | 3.8E−01 | 5.5E−01 | −0.44 | APH(6)-Id |
| ARO_3000838 | 3.8E−01 | 5.5E−01 | −0.03 | arlR |
| ARO_3000839 | 3.8E−01 | 5.5E−01 | −0.02 | arlS |
| ARO_3002847 | 3.8E−01 | 5.5E−01 | −0.04 | arr-2 |
| ARO_3002854 | 3.2E−01 | 5.5E−01 | −0.18 | dfrA1 |
| ARO_3003013 | 3.8E−01 | 5.5E−01 | −0.03 | dfrA15 |
| ARO_3002860 | 3.4E−01 | 5.5E−01 | 0.14 | dfrA17 |
| ARO_3003953 | 3.8E−01 | 5.5E−01 | 0.01 | hmrM |
| ARO_3002259 | 3.8E−01 | 5.5E−01 | −0.02 | IND-3 |
| ARO_3003111 | 3.8E−01 | 5.5E−01 | −0.15 | IsaB |
| ARO_3000800 | 3.2E−01 | 5.5E−01 | −0.17 | MexC |
| ARO_3000808 | 3.5E−01 | 5.5E−01 | −0.14 | mexI |
| ARO_3003692 | 3.3E−01 | 5.5E−01 | −0.16 | mexJ |
| ARO_3003035 | 3.8E−01 | 5.5E−01 | −0.01 | mfpA |
| ARO_3004074 | 3.3E−01 | 5.5E−01 | −0.08 | MuxB |
| ARO_3000802 | 3.8E−01 | 5.5E−01 | −0.12 | OprJ |
| ARO_3000805 | 3.8E−01 | 5.5E−01 | −0.09 | OprN |
| ARO_3001710 | 3.4E−01 | 5.5E−01 | 0.18 | OXA-211 |
| ARO_3001398 | 3.8E−01 | 5.5E−01 | 0.02 | OXA-3 |
| ARO_3000822 | 3.6E−01 | 5.5E−01 | 0.03 | pmrA |
| ARO_3002794 | 3.2E−01 | 5.5E−01 | 0.01 | QnrS5 |
| ARO_3001301 | 3.5E−01 | 5.5E−01 | 0.05 | RlmA(II) |
| ARO_3003056 | 3.8E−01 | 5.5E−01 | −0.01 | smeE |
| ARO_3002493 | 3.8E−01 | 5.5E−01 | −0.01 | SRT-1 |
| ARO_3000168 | 3.7E−01 | 5.5E−01 | −0.04 | tet(D) |
| ARO_3000178 | 3.8E−01 | 5.5E−01 | 0.01 | tet(K) |
| ARO_3000186 | 3.4E−01 | 5.5E−01 | −0.22 | tetM |
| ARO_3000193 | 3.8E−01 | 5.5E−01 | 0.00 | tetT |
| ARO_3000005 | 3.4E−01 | 5.5E−01 | −0.20 | van D |
| ARO_3002934 | 3.6E−01 | 5.5E−01 | −0.47 | vanSD |
| ARO_3002935 | 3.8E−01 | 5.5E−01 | −0.03 | vanSE |
| ARO_3002953 | 3.8E−01 | 5.5E−01 | −0.01 | vanXM |
| ARO_3004075 | 3.8E−01 | 5.5E−01 | −0.15 | MuxC |
| ARO_3000410 | 3.9E−01 | 5.6E−01 | 0.20 | sul1 |
| ARO_3002598 | 4.0E−01 | 5.7E−01 | −0.17 | ANT(3")-Ii-AAC(6')-IId fusion protein |
| ARO_3001396 | 4.1E−01 | 5.8E−01 | −0.32 | OXA-1 |
| ARO_3000616 | 4.2E−01 | 5.9E−01 | 0.12 | mel |
| ARO_3004038 | 4.3E−01 | 6.0E−01 | −0.20 | *Pseudomonas aeruginosa* emrE |
| ARO_3000498 | 4.4E−01 | 6.1E−01 | −1.33 | ErmF |
| ARO_3004054 | 4.4E−01 | 6.2E−01 | −0.11 | *Pseudomonas aeruginosa* CpxR |
| ARO_3002982 | 4.6E−01 | 6.4E−01 | −0.11 | amrA |
| ARO_3000593 | 4.6E−01 | 6.4E−01 | 0.19 | ErmQ |
| ARO_3000801 | 4.6E−01 | 6.4E−01 | −0.18 | MexD |
| ARO_3003839 | 4.7E−01 | 6.4E−01 | 0.11 | Mrx |
| ARO_3003680 | 4.8E−01 | 6.6E−01 | −0.25 | TriB |
| ARO_3003030 | 5.2E−01 | 7.0E−01 | −0.17 | mexV |
| ARO_3000167 | 5.3E−01 | 7.1E−01 | 0.02 | tet(C) |
| ARO_3001307 | 5.3E−01 | 7.1E−01 | −0.02 | VgbA |
| ARO_3003954 | 5.4E−01 | 7.2E−01 | 0.00 | efmA |
| ARO_3000804 | 5.4E−01 | 7.2E−01 | 0.04 | MexF |
| ARO_3000412 | 5.5E−01 | 7.3E−01 | −0.25 | sul2 |
| ARO_3003583 | 5.5E−01 | 7.3E−01 | −0.19 | basS |
| ARO_3002684 | 5.6E−01 | 7.3E−01 | −0.03 | catII |
| ARO_3003948 | 5.5E−01 | 7.3E−01 | −0.04 | efrA |
| ARO_3000230 | 5.6E−01 | 7.3E−01 | 0.00 | ANT(2")-Ia |
| ARO_3002966 | 5.8E−01 | 7.5E−01 | −0.15 | vanXYC |
| ARO_3000190 | 5.8E−01 | 7.5E−01 | 0.35 | tetO |
| ARO_3002645 | 5.9E−01 | 7.5E−01 | −0.11 | APH(3')-IIb |
| ARO_3003097 | 5.9E−01 | 7.5E−01 | −0.12 | CfxA6 |
| ARO_3000522 | 5.9E−01 | 7.5E−01 | −0.53 | ErmG |
| ARO_3000595 | 5.9E−01 | 7.5E−01 | −0.30 | ErmT |
| ARO_3002881 | 6.0E−01 | 7.5E−01 | 0.03 | ImrC |
| ARO_3002895 | 6.0E−01 | 7.5E−01 | −0.16 | SAT-1 |
| ARO_3003070 | 6.0E−01 | 7.5E−01 | −0.13 | vanXD |
| ARO_3002535 | 6.1E−01 | 7.5E−01 | −0.22 | AAC(3)-IIc |
| ARO_3002539 | 6.1E−01 | 7.5E−01 | −0.29 | AAC(3)-IV |
| ARO_3000174 | 6.1E−01 | 7.5E−01 | 0.01 | tet(G) |
| ARO_3002944 | 6.1E−01 | 7.6E−01 | −0.03 | vanHD |

TABLE 1-continued

| Change in abundance of genes in response to treatment | | | | |
|---|---|---|---|---|
| CARD accession | p-value | FDR | log2 Engrafters - log2 Placebo | Gene Symbol |
| ARO_3003717 | 6.4E−01 | 7.8E−01 | −0.05 | ESP-1 |
| ARO_3000181 | 6.4E−01 | 7.8E−01 | 0.01 | tet(V) |
| ARO_3003710 | 6.5E−01 | 7.9E−01 | −0.06 | mexL |
| ARO_3000165 | 6.5E−01 | 7.9E−01 | −0.15 | tet(A) |
| ARO_3002931 | 6.5E−01 | 7.9E−01 | −0.03 | vanSA |
| ARO_3000010 | 6.7E−01 | 8.1E−01 | −0.03 | vanA |
| ARO_3002605 | 6.7E−01 | 8.1E−01 | 0.00 | aadA5 |
| ARO_3001933 | 7.1E−01 | 8.5E−01 | −0.63 | CTX-M-72 |
| ARO_3000175 | 7.1E−01 | 8.5E−01 | 0.01 | tet(H) |
| ARO_3002556 | 7.1E−01 | 8.5E−01 | 0.05 | AAC(6)-Ii |
| ARO_3002680 | 7.2E−01 | 8.6E−01 | −0.25 | catB8 |
| ARO_3000809 | 7.3E−01 | 8.6E−01 | −0.14 | opmD |
| ARO_3002897 | 7.3E−01 | 8.6E−01 | −0.37 | SAT-4 |
| ARO_3001313 | 7.3E−01 | 8.6E−01 | 0.00 | facT |
| ARO_3003197 | 7.4E−01 | 8.7E−01 | −0.06 | aadA25 |
| ARO_3003949 | 7.7E−01 | 9.0E−01 | 0.00 | efrB |
| ARO_3003682 | 7.7E−01 | 9.0E−01 | −0.13 | OpmH |
| ARO_3001959 | 7.8E−01 | 9.0E−01 | −0.45 | CTX-M-100 |
| ARO_3002942 | 7.9E−01 | 9.1E−01 | −0.02 | vanHA |
| ARO_3003559 | 8.1E−01 | 9.3E−01 | −0.29 | cepA beta-lactamase |
| ARO_3002628 | 8.2E−01 | 9.4E−01 | −0.02 | aad(6) |
| ARO_3000596 | 8.2E−01 | 9.4E−01 | 0.02 | ErmX |
| ARO_3002949 | 8.2E−01 | 9.4E−01 | −0.05 | vanXA |
| ARO_3002837 | 8.3E−01 | 9.4E−01 | −0.30 | InuC |
| ARO_3002756 | 8.3E−01 | 9.4E−01 | 0.21 | OnrB41 |
| ARO_3002875 | 8.4E−01 | 9.4E−01 | 0.04 | dfrE |
| ARO_3002647 | 8.5E−01 | 9.5E−01 | 0.00 | APH(3)-IIIa |
| ARO_3000179 | 8.5E−01 | 9.5E−01 | −0.21 | tet(L) |
| ARO_3002069 | 8.6E−01 | 9.6E−01 | −0.09 | CMY-59 |
| ARO_3002019 | 9.0E−01 | 9.8E−01 | 0.01 | CMY-8 |
| ARO_3003095 | 9.0E−01 | 9.8E−01 | 0.12 | imiS |
| ARO_3002225 | 9.0E−01 | 9.8E−01 | −0.03 | IMP-34 |
| ARO_3001413 | 9.0E−01 | 9.8E−01 | 0.01 | OXA-18 |
| ARO_3000565 | 9.0E−01 | 9.8E−01 | 0.00 | tet(38) |
| ARO_3000177 | 8.8E−01 | 9.8E−01 | −0.25 | tet(J) |
| ARO_3002882 | 9.1E−01 | 9.8E−01 | 0.07 | ImrD |
| ARO_3002363 | 9.1E−01 | 9.8E−01 | 0.02 | PER-1 |
| ARO_3003069 | 9.1E−01 | 9.8E−01 | −0.02 | vanXYG |
| ARO_3002819 | 9.2E−01 | 9.9E−01 | −0.03 | msrC |
| ARO_3003210 | 9.4E−01 | 9.9E−01 | −0.27 | FosA4 |
| ARO_3000026 | 9.4E−01 | 9.9E−01 | −0.01 | mepA |
| ARO_3000746 | 9.4E−01 | 9.9E−01 | 0.00 | mepR |
| ARO_3000815 | 9.4E−01 | 9.9E−01 | 0.00 | mgrA |
| ARO_3003199 | 1.0E+00 | 1.0E+00 | 0.02 | AAC(6')-Iak |
| ARO_3002613 | 9.6E−01 | 1.0E+00 | 0.01 | aadA13 |
| ARO_3002641 | 9.7E−01 | 1.0E+00 | −0.07 | APH(3')-Ia |
| ARO_3002655 | 1.0E+00 | 1.0E+00 | −0.24 | APH(4)-Ia |
| ARO_3003730 | 1.0E+00 | 1.0E+00 | −0.06 | Bifidobacteria intrinsic ileS conferring resistance to mupirocin |
| ARO_3001920 | 9.8E−01 | 1.0E+00 | −0.09 | CTX-M-59 |
| ARO_3003955 | 9.9E−01 | 1.0E+00 | −0.03 | efpA |
| ARO_3000375 | 9.6E−01 | 1.0E+00 | 0.07 | ErmB |
| ARO_3004085 | 1.0E+00 | 1.0E+00 | −0.06 | InuG |
| ARO_3002665 | 9.9E−01 | 1.0E+00 | −0.16 | npmA |
| ARO_3003700 | 9.9E−01 | 1.0E+00 | −0.18 | opmE |
| ARO_3002788 | 1.0E+00 | 1.0E+00 | −0.04 | QnrD1 |
| ARO_3001388 | 9.6E−01 | 1.0E+00 | −0.37 | TEM-211 |
| ARO_3000556 | 9.5E−01 | 1.0E+00 | −0.01 | tet44 |
| ARO_3004035 | 9.7E−01 | 1.0E+00 | −0.01 | tetA(60) |
| ARO_3002909 | 1.0E+00 | 1.0E+00 | 0.00 | vanG |
| ARO_3002919 | 9.9E−01 | 1.0E+00 | −0.08 | vanRA |
| ARO_3002922 | 1.0E+00 | 1.0E+00 | −0.06 | vanRC |
| ARO_3002955 | 9.5E−01 | 1.0E+00 | 0.01 | vanYA |
| ARO_3002962 | 1.0E+00 | 1.0E+00 | −0.09 | vanZA |

TABLE 2

| Engraftment of spores is associated with significant reduction in antibiotic resistance genes | | | | |
|---|---|---|---|---|
| Drug Class | log2FC high engrafters - log2 Placebo | p-value | FDR | Examples of antibiotics in drug class |
| Aminocoumarin antibiotic | −1.534 | 0.003 | 0.035 | Novobiocin, Albamycin, Coumemycin, Clorobiocin |
| Aminoglycoside antibiotic | −1.241 | 0.009 | 0.035 | Kanamycin, Amikacin, Tobramycin, Dibekacin, Gentamicin, Sisomicin, Netilmicin, Neomycins (B, C, E) Streptomycin |
| cephalosporin | −1.428 | 0.014 | 0.035 | Cefacetrill, Cefradrin, Cefroxadin, Cefaloglycin, Cefaclor, Cefalexin, Cefadroxil, Cefatrizin, Cefazedon, Cefapirin, Ceftezol, Cefazolin, Cefazaflur, Cefalotin, Cefaloridin, Cefalonium |
| cephamycin | −1.214 | 0.008 | 0.035 | Cefoxitin, Cefotetan, Cefmetazole |
| Fluoroquinolone antibiotic | −1.401 | 0.007 | 0.035 | Flumequine, oxolinic acid, rosoxacin, ciprofloxacin, fleroxacin, lomefloxacin, nadifloxacin, norfloxacin, ofloxacin, pefloxacin, rufloxacin, balofloxacin, grepafloxacin, levofloxacin, pazufloxacin, sparfloxacin, temafloxacin, clinafloxacin, gatifloxacin, moxifloxacin, sitafloxacin, prulifloxacin, besifloxacin, delafloxacin, ozenoxacin, danofloxacin, difloxacin, enrofloxacin, ibafloxacin, marbofloxacin, orbifloxacin, sarafloxacin |
| glycylcycline | −1.658 | 0.009 | 0.035 | Tigercycline |
| Macrolide antibiotic | −1.288 | 0.002 | 0.035 | Erythromycin, Clarithromycin, Roxithromycin |
| Nitroimidazole antibiotic | −1.477 | 0.013 | 0.035 | Nitroimidazole |
| Nucleoside antibiotic | −1.347 | 0.011 | 0.035 | Tunicamycin, Streptothricin |
| penam | −1.424 | 0.010 | 0.035 | Benzylpenicillin |
| Peptide antibiotic | −1.279 | 0.006 | 0.035 | |
| Phenicol antibiotic | −1.139 | 0.012 | 0.035 | chloramphenicol |
| Rifamycin antibiotic | −1.470 | 0.006 | 0.035 | rifamycin |
| Benzalkonium chloride | −1.016 | 0.019 | 0.035 | Benzalkonium chloride |
| monobactam | −1.114 | 0.018 | 0.035 | Aztreonam |
| penem | −1.155 | 0.015 | 0.035 | Faropenem |
| rhodamine | −1.016 | 0.019 | 0.035 | rhodamine |
| triclosan | −1.234 | 0.018 | 0.035 | triclosan antibiotics |
| Lincosamide antibiotic | −1.123 | 0.021 | 0.037 | lincomycin, clindamycin, pirlimycin |
| Streptogramin antibiotic | −1.065 | 0.035 | 0.057 | streptogramin |

TABLE 2-continued

Engraftment of spores is associated with significant reduction in antibiotic resistance genes

| Drug Class | log2FC high engrafters - log2 Placebo | p-value | FDR | Examples of antibiotics in drug class |
|---|---|---|---|---|
| Acridine dye | −0.905 | 0.043 | 0.067 | |
| carbapenem | −1.239 | 0.052 | 0.075 | carbapenem |
| Tetracycline antibiotic | −0.558 | 0.050 | 0.075 | tetracycline |
| fosfomycin | −1.024 | 0.066 | 0.091 | fosfomycin |

Example 2: Bacteria Associated with Changes in Abundance of Abx Resistance Genes Computational analysis to determine whether the presence of specific bacterial species is predictive of a decrease in the abundance of antibiotic resistance genes was performed. Species identified in these analyses can be used in designed Abx compositions. To identify microbial species that are associated with a reduction of antimicrobial resistance genes, we calculated the Spearman correlation between species abundance and the DCMA of drug classes showing a significant reduction in subjects in whom engraftment of spores was observed relative to placebo. P-values were adjusted to account for multiple hypothesis testing using the Benjamini-Hochberg procedure ($p<0.1$) as described supra. The set of species associated with significant reduction of at least one drug of antibiotic resistance genes is summarized in Table 3. We have further defined the set of species positively correlated with elevated abundances of at least one class of antibiotic resistance genes, summarized in Table 4. Dose species in all tables are bacterial species identified in dose lots administered to subjects. Full length 16S sequences of species described herein are provided in Tables 5 (negative correlates) and 6 (positive correlates). In some embodiments, the bacterium(a) are from a genus listed below. Those of skill in the art can use standard methods to identify the genera.

TABLE 3

Species significantly correlated with reduction of at least one class of antibiotic resistance genes

| Species | Number of drug classes with significant reduction | Spore-former (Y/N) | Dose Species (Y/N) | Exemplary sequence identifier | Representative Genome Accession Number(s) (NCBI) |
|---|---|---|---|---|---|
| Anaerofustis_stercorihominis | 21 | Y | Y | 96, 97 | GCF_000154825 |
| Anaerostipes_caccae | 20 | Y | N | 62-66 | GCF_000154305 |
| Anaerostipes_hadrus | 23 | Y | Y | 223 | GCF_000332875 |
| Anaerostipes_sp. | 24 | Y | Y | 24 | GCA_900066985 |
| Anaerostipes_unclassified | 21 | N | N | | |
| Anaerotruncus_colihominis | 24 | Y | Y | 89-92 | GCF_000154565 |
| Anaerotruncus_unclassified | 22 | N | N | | |
| Bacteroides_fragilis | 18 | N | N | 184-191 | GCF_000273095 |
| Bacteroides_uniformis | 6 | N | N | 192-198 | GCF_000273275 |
| Bacteroides_vulgatus | 16 | N | N | 199-204 | GCF_000273295 |
| Blautia_faecis (a) | 22 | Y | Y | 9 | GCA_900066145 |
| Blautia_faecis (b) | 24 | Y | Y | 22 | GCA_900066945 |
| Blautia_hydrogenotrophica | 22 | Y | Y | 101 | GCF_000157975 |
| Blautia_producta | 21 | Y | Y | 281 | GCF_000373885 |
| Blautia_sp. | 22 | Y | Y | 268, 269 | |
| Blautia_sp_CAG_257 | 22 | Y | Y | 261 | |
| Blautia_wexlerae | 24 | Y | Y | 104-110, 255 | GCF_000159975 |
| Clostridiaceae_bacterium_JC118 | 21 | Y | Y | 222 | GCF_000313565 |
| Clostridiales bacterium_1_7_47FAA | 23 | Y | Y | 98 | GCF_000155435 |
| Clostridium_aldenense | 21 | Y | Y | 278 | |
| Clostridium_asparagiforme | 22 | Y | Y | 103 | GCF_000158075 |
| Clostridium_bardettii | 24 | Y | Y | 80-85 | GCF_000154445 |
| Clostridium_bolteae | 23 | Y | Y | 73 | GCF_000154365 |
| Clostridium_clostridioforme | 21 | Y | Y | 231-233 | GCF_000371525 |
| Clostridium_hathewayi | 24 | Y | Y | 229, 230 | GCF_000371445 |
| Clostridium_lavalense | 20 | Y | Y | 280 | |
| Clostridium_leptum | 22 | Y | Y | 71, 72 | GCF_000154345 |
| Clostridium_nexile | 24 | Y | N | 282 | GCF_000156035 |
| Clostridium_ramosum | 21 | Y | Y | 86 | GCF_000154485 |
| Clostridium_sp. | 21 | Y | Y | 21 | GCA_900066915 |
| Clostridium_sp. | 22 | Y | Y | 18 | GCA_900066805 |
| Clostridium_sp. | 22 | Y | Y | 6 | GCA_900066055 |
| Clostridium_sp. | 22 | Y | Y | 12 | GCA_900066535 |
| Clostridium_sp. | 23 | Y | Y | 11 | GCA_900066365 |
| Clostridium_sp. | 24 | Y | Y | 8 | GCA_900066135 |
| Clostridium_sp. | 24 | Y | Y | | |
| Clostridium_sp. | 23 | Y | Y | 17 | GCA_900066795 |
| Clostridium_sp. | 22 | Y | Y | 15, 16 | GCA_900066785 |
| Clostridium_sp. | 23 | Y | Y | 10 | GCA_900066155 |
| Clostridium_scindens | 21 | Y | Y | 87, 88 | GCF_000154505 |
| Clostridium_sp_CAG_91 | 23 | Y | Y | 266 | |
| Clostridium_sp_KLE_1755 | 22 | Y | N | 247 | GCF_000466465 |
| Clostridium_symbiosum | 23 | Y | Y | 248 | GCF_000466485 |
| Coprobacillus_unclassified | 21 | N | N | | |

TABLE 3-continued

Species significantly correlated with reduction of at least one class of antibiotic resistance genes

| Species | Number of drug classes with significant reduction | Spore-former (Y/N) | Dose Species (Y/N) | Exemplary sequence identifier | Representative Genome Accession Number(s) (NCBI) |
|---|---|---|---|---|---|
| Coprococcus_catus | 22 | Y | Y | 143 | GCF_000210555 |
| Coprococcus_comes | 21 | Y | Y | 99 | GCF_000155875 |
| Dialister_invisus | 21 | N | N | 111-113 | GCF_000160055 |
| Dorea_formicigenerans | 22 | Y | Y | 114-119 | GCF_000169235 |
| Dorea_longicatena | 21 | Y | Y | 60, 61 | GCF_000154065 |
| Eggerthella_lenta | 22 | N | N | 39-41 | GCF_000024265 |
| Eggerthella_unclassifted | 20 | N | N | | |
| Emergencia_timonensis | 22 | Y | Y | 14 | GCA_900066695 |
| Erysipelotrichaceae_bacterium_21_3 | 21 | N | N | 164-168 | GCF_000242195 |
| Erysipelotrichaceae_bacterium_6_1_45 | 21 | N | N | 160-163 | GCF_000242175 |
| Eubacterium_contortum | 23 | Y | Y | 272-275 | |
| Eubacterium_eligens | 22 | Y | Y | 43-47 | GCF_000146185 |
| Eubacterium_hallii | 22 | Y | Y | 120 | GCF_000173975 |
| Eubacterium_ramulus | 22 | Y | Y | 249 | GCF_000469345 |
| Eubacterium_rectale | 23 | Y | Y | 34-38 | GCF_000020605 |
| Eubacterium_sp. | 21 | Y | Y | | |
| Eubacterium_sp_3_1_31 | 20 | Y | Y | 205-209, 262 | GCF_000273585 |
| Eubacterium_ventriosum | 23 | Y | Y | 48 | GCF_000153885 |
| Faecalibacterium_prausnitzii | 24 | Y | Y | 74-79 | GCF_000154385 |
| Flavonifractor_plautii | 23 | Y | Y | 158 | GCF_000239295 |
| Flavonifractor_sp. (a) | 21 | Y | Y | 19 | GCA_900066825 |
| Flavonifractor_sp. (b) | 23 | Y | Y | 13 | GCA_900066645 |
| Fusicatenibacter_saccharivorans | 23 | Y | Y | 4 | GCA_001405555 |
| Gemmiger_formicilis_(a) | 24 | Y | Y | 256 | |
| Gemmiger_formicilis_(b) | 24 | Y | Y | 263 | |
| Holdemania_filiformis | 24 | Y | Y | 102 | GCF_000157995 |
| Holdemania_unclassified | 24 | N | N | | |
| Intestinimonas_butyriciproducens | 23 | Y | Y | 264 | |
| Intestinimonas_massiliensis | 22 | N | N | 20 | GCA_900066895 |
| Lachnospira_pectinoschiza | 24 | Y | Y | 5 | GCA_001405835 |
| Lachnospira_pectinoschiza | 19 | Y | Y | 270 | |
| Lachnospiraceae_bacterium_1_1_57FAA | 23 | Y | Y | 150 | GCF_000218445 |
| Lachnospiraceae_bacterium_1_4_56FAA | 21 | Y | Y | 145 | GCF_000218385 |
| Lachnospiraceae_bacterium_2_1_58FAA | 23 | Y | Y | 151 | GCF_000218465 |
| Lachnospiraceae_bacterium_3_1_46FAA | 22 | Y | Y | 139 | GCF_000209405 |
| Lachnospiraceae_bacterium_3_1_57FAA_CT1 | 22 | Y | Y | 146-148 | GCF_000218405 |
| Lachnospiraceae_bacterium_4_1_37FAA | 18 | Y | N | 137 | GCF_000191805 |
| Lachnospiraceae_bacterium_5_1_57FAA | 22 | Y | Y | 149 | GCF_000218425 |
| Lachnospiraceae_bacterium_5_1_63FAA | 24 | Y | Y | 134 | GCF_000185525 |
| Lachnospiraceae_bacterium_7_1_58FAA | 23 | Y | Y | 159 | GCF_000242155 |
| Lachnospiraceae_bacterium_8_1_57FAA | 21 | Y | Y | 135 | GCF_000185545 |
| Lachnospiraceae_bacterium 9_1_43BFAA | 24 | Y | Y | 141 | GCF_000209445 |
| Lactonifactor_longoviformis | 23 | Y | Y | 271 | |
| Oscillibacter_unclassified | 23 | N | N | | |
| Oscillospiraceae_bacterium_VE202_24 | 23 | N | N | 265 | |
| Parabacteroides_unclassified | 18 | N | N | | |
| Prevotella_buccae | 22 | N | N | 133 | GCF_000184945 |
| Roseburia_faecis | 23 | Y | Y | 259 | |
| Roseburia_hominis | 21 | Y | Y | 152-155 | GCF_000225345 |
| Roseburia_intestinalis | 23 | Y | Y | 100 | GCF_000156535 |
| Roseburia_inulinivorans | 24 | Y | Y | 283 | GCF_000174195 |
| Ruminococcus_bicirculans | 23 | Y | Y | 25, 26 | GCA_900067025 |
| Ruminococcus_bromii | 22 | Y | Y | 142 | GCF_000209875 |
| Ruminococcus_gnavus | 23 | Y | Y | 250-254, 277 | GCF_000507805 |
| Ruminococcus_obeum_(a) | 23 | Y | Y | 49-53 | GCF_000153905 |
| Ruminococcus_obeum_(b) | 19 | Y | Y | 267 | |
| Ruminococcus_sp. | 22 | Y | Y | 7, 258 | GCA_900066095 |
| Ruminococcus_torques | 24 | Y | Y | 54-59 | GCF_000153925 |
| Streptococcus_parasanguinis | 21 | N | N | 170-173 | GCF_000262145 |
| Streptococcus_salivarius | 21 | N | N | 210-216 | GCF_000286295 |
| Subdoligranulum_unclassified | 23 | N | N | | |
| Sutterella_wadsworthensis | 9 | N | N | 243-246 | GCF_000411515 |
| Bacteroides_thetaiotaomicron | 1 | N | N | 239-242 | GCF_000403155 |
| Haemophilus_parainfluenzae | 7 | N | N | 169 | GCF_000261285 |
| Parabacteroides_distasonis | 2 | N | N | 217-221 | GCF_000307435 |
| Akkermansia_muciniphila | 17 | N | N | 31-33 | GCF_000020225 |
| Bacteroides_dorei | 11 | N | N | 174-183 | GCF_000273055 |
| Butyrivibrio_sp. | 15 | N | N | 260 | |
| Clostridium_citroniae | 20 | Y | Y | 157 | GCF_000233455 |
| Clostridium_difficile | 8 | Y | N | 1-3 | GCA_000451045 |

TABLE 3-continued

Species significantly correlated with reduction of at least one class of antibiotic resistance genes

| Species | Number of drug classes with significant reduction | Spore-former (Y/N) | Dose Species (Y/N) | Exemplary sequence identifier | Representative Genome Accession Number(s) (NCBI) |
|---|---|---|---|---|---|
| Clostridium_disporicum | 9 | Y | Y | 23 | GCA_900066955 |
| Clostridium_innocuum | 4 | Y | Y | 224-228 | GCF_000371425 |
| Clostridium_spiroforme | 11 | Y | Y | 93-95 | GCF_000154805 |
| Dorea_unclassified | 13 | N | N | | |
| Eisenbergiella_massiliensis | 11 | Y | Y | 257 | |
| Eisenbergiella_tayi_sp. | 14 | Y | Y | 276 | |
| Erysipelotrichaceae_bacterium_2_2_44A | 20 | N | N | 156 | GCF_000225685 |
| Eubacterium_siraeum | 14 | Y | Y | 67-70 | GCF_000154325 |
| Lachnospiraceae_bacterium_6_1_63FAA | 11 | Y | N | 140 | GCF_000209425 |
| Ruminococcaceae_bacterium_D16 | 19 | Y | Y | 121 | |
| Ruminococcus_gnavus | 7 | Y | Y | 250-254, 277 | GCF_000507805 |
| Ruminococcus_sp. | 12 | Y | Y | 7, 258 | GCF_000507805 |
| Streptococcus_australis | 4 | N | N | 136 | GCF_000186465 |
| Streptococcus_gordonii | 3 | N | N | 27-30 | GCF_000017005 |
| Streptococcus_infantis | 5 | N | N | 284-286 | GCF_000215385, GCF_000187465, GCF_000223335, GCF_000223255, GCF_000260755 |
| Streptococcus_sanguinis | 5 | N | N | 138 | GCF_000192205 |
| Dysgonomonas_mossii | 6 | N | N | 144 | GCF_000213575 |
| Streptococcus_thermophilus | 1 | N | N | 128-132 | GCF_000182875 |
| Peptostreptococcaceae_noname_unclassifted | 10 | N | N | | |
| Turicibacter_unclassified | 6 | N | N | | |
| Burkholderiales_bacterium_1_1_47 | 3 | N | N | 42 | GCF_000144975 |
| Clostridium_sp_CL_6 | 4 | Y | N | 287 | |
| Desulfovibrio_desulfuricans | 1 | N | N | | GCF_000384815, GCF_000022125, GCF_000420465, GCF_000189295 |
| Lactobacillus_fermentum | 1 | N | N | 234-238 | GCF_000397165 |
| Streptococcus_vestibularis | 1 | N | N | 122-127 | GCF_000180075 |

TABLE 4

Species significantly positively correlated with elevated abundances of at least one class of antibiotic resistance genes

| Species | Number of drug classes associated with increasing species abundance | Spore-former (Y/N) | Dose Species (Y/N) | Exemplary sequence identifier | Representative Genome Accession Number(s) (NCBI) |
|---|---|---|---|---|---|
| Campylobacter_curvus | 20 | N | N | 367 | GCF_000376325 |
| Citrobacter_freundii | 22 | N | N | 361, 362 | GCF_000312465 |
| Citrobacter_unclassified | 22 | N | N | | |
| Desulfovibrio_desulfuricans | 6 | N | N | | GFC_000384815, GCF_000022125, GCF_000420465, GCF_000189295 |
| Enterobacter_cloacae | 22 | N | N | 387 | GCF_000467655 |
| Enterococcus_faecalis | 21 | N | N | | GCF_000393515, GCF_000394095, GCF_000393615, GCF_000157495, GCF_000390625, GCF_000390925, GCF_000148005, GCF_000148065, GCF_000394075, GCF_000393495, GCF_000391465, GCF_000392675, GCF_000396365, GCF_000157475, |

TABLE 4-continued

Species significantly positively correlated with elevated abundances of at least one class of antibiotic resistance genes

| Species | Number of drug classes associated with increasing species abundance | Spore-former (Y/N) | Dose Species (Y/N) | Exemplary sequence identifier | Representative Genome Accession Number(s) (NCBI) |
|---|---|---|---|---|---|
| | | | | | GCF_000396665, GCF_000148245, GCF_000393155, GCF_000148165, GCF_000391165, GCF_000157515, GCF_000396085, GCF_000395285, GCF_000479065, GCF_000393095, GCF_000393255, GCF_000391065, GCF_000394955, GCF_000415065, GCF_000394975, GCF_000415085, GCF_000395405, GCF_000172575, GCF_000390525, GCF_000393115, GCF_000394775, GCF_000393475, GCF_000390705, GCF_000205205, GCF_000395135, GCF_000392815, GCF_000320305, GCF_000396205, GCF_000390665, GCF_000390685, GCF_000391725, GCF_000163815, GCF_000391605, GCF_000391445, GCF_000391425, GCF_000396185, GCF_000148445, GCF_000148125, GCF_000396605, GCF_000396045, GCF_000291565, GCF_000394315, GCF_000395035, GCF_000147455, GCF_000391345, GCF_000396525, GCF_000392755 |
| Escherichia_coli | 24 | N | N | 388-394 | GCF_000474825 |
| Escherichia_unclassified | 23 | N | N | | |
| Fusobacterium_nucleatum | 15 | N | N | 403 | GCF_000479185 |
| Klebsiella_oxytoca | 22 | N | N | 330 | GCF_000252915 |
| Klebsiella_pneumoniae | 22 | N | N | 395-402 | GCF_000474865 |
| Klebsiella_unclassified | 21 | N | N | | |
| Lactobacillus_animalis | 22 | N | N | 317 | GCF_000183825 |
| Lactobacillus_casei_paracasei | 22 | N | N | 378, 379, 381-385 | GCF_000409835, GCF_000418515 |
| Lactobacillus_plantarum | 22 | N | N | 386 | GCF_000463075 |
| Lactobacillus_rhamnosus | 24 | N | N | 328, 329 | GCF_000235785 |
| Lactobacillus_salivarius | 9 | N | N | 303 | GCF_000159395 |
| Lactococcus_lactis | 15 | N | N | 363, 364 | GCF_000348965 |
| Megasphaera_micronuciformis | 22 | N | N | 310 | GCF_000165735 |
| Megasphaera_unclassified | 11 | N | N | | |
| Morganella_morganii | 24 | N | N | 355 | GCF_000286435 |
| Pantoea_unclassified | 24 | N | N | | |
| Pediococcus_acidilactici | 19 | N | N | 299 | GCF_000146325 |
| Proteus_penneri | 17 | N | N | 301, 302 | GCF 000155835 |
| Streptococcus_mitis_oralis_pneumoniae | 3 | N | N | 288-291, 332 | GCF_000014365, GCF_000257865 |
| Streptococcus_thermophilus | 5 | N | N | 312-316 | GCF_000182875 |

TABLE 4-continued

Species significantly positively correlated with elevated abundances of at least one class of antibiotic resistance genes

| Species | Number of drug classes associated with increasing species abundance | Spore-former (Y/N) | Dose Species (Y/N) | Exemplary sequence identifier | Representative Genome Accession Number(s) (NCBI) |
|---|---|---|---|---|---|
| Veillonella_atypica | 19 | N | N | 311 | GCF_000179755 |
| Veillonella_dispar | 18 | N | N | 304-306 | GCF_000160015 |
| Veillonella_parvula | 13 | N | N | 322 | GCF_000215025 |
| Bifidobacterium_dentium | 1 | N | N | 300 | GCF_000146775 |
| Butyrivibrio_sp. | 1 | N | N | 404 | |
| Clostridium_sp_CL_6 | 1 | Y | N | 287 | NCBI Taxonomy ID 1499683 |
| Enterococcus_faecium | 18 | N | N | 380 | GCF_000414965 |
| Erysipelotrichaceae_bacterium_2_2_44A | 1 | N | N | 326 | GCF_000225685 |
| Lactobacillus_fermentum | 2 | N | N | 368-372 | GCF_000397165 |
| Lactobacillus_gasseri | 1 | N | N | 377 | GCF_000406345 |
| Proteus_mirabilis | 8 | N | N | 292-298 | GCF_000069965 |
| Rothia_dentocariosa | 5 | N | N | 307-309 | GCF 000164695 |
| Proteus_unclassified | 5 | N | N | | |
| Veillonella_unclassified | 14 | N | N | | |
| Alistipes_onderdonkii | 1 | N | N | 365, 366 | GCF_000374505 |
| Bacteroides_ovatus | 5 | N | N | 333-336 | GCF_000273195 |
| Bacteroides_vulgatus | 4 | N | N | 344-349 | GCF_000273295 |
| Bilophila_unclassified | 3 | N | N | | |
| Bilophila_wadsworthia | 3 | N | N | 318-321 | GCF_000185705 |
| Parabacteroides_distasonis | 6 | N | N | 356-360 | GCF_000307435 |
| Parabacteroides_unclassified | 3 | N | N | | |
| Alistipes_unclassified | 2 | N | N | | |
| Rothia_mucilaginosa | 1 | N | N | 327 | GCF_000231235 |
| Bacteroides_thetaiotaomicron | 1 | N | N | 373-376 | GCF_000403155 |
| Bacteroides_uniformis | 2 | N | N | 337-343 | GCF_000273275 |
| Eggerthella_unclassified | 1 | N | N | | |
| Eubacterium sp 3_1_31 | 2 | Y | Y | 350-354 | GCF_000273585 |
| Lachnospiraceae_bacterium_3_1_57FAA_CT1 | 1 | Y | Y | 323-325 | GCF_000218405 |
| Ruminococcus_obeum | 1 | Y | Y | 405 | |
| Turicibacter_unclassified | 1 | N | N | | |
| Clostridium_perfringens | 1 | Y | Y | 331 | GCF_000255475 |

TABLE 5

Full length 16S rDNA sequences of species (negative correlates)

| Species Name | Sequence Identifier | 16S rDNA sequence |
|---|---|---|
| *Clostridium _difficile* | SEQ ID NO: 1 | ttatgagagtttgatcctggctcaggacgaacgctggcggcgtgcctaatacatgcaagtcgaacgcttctttttccaccggagc<br>ttgctccaccggaaaaagaggagtggcgaacgggtgagtaacacgtgggtaacctgcccatcagaaggggataacacttgg<br>aaacaggtgctaataccgtataacaatcgaaaccgcatggttttgatttgaaaggcgctttcgggtgtcgctgatggatggaccc<br>gcggtgcattagctagttggtgaggtaacggctcaccaaggccacgatgcatagccgacctgagagggtgatcggccacatt<br>gggactgagacacggcccaaactcctacgggaggcagcagtagggaatcttcggcaatggacgaaagtctgaccgagcaa<br>cgccgcgtgagtgaagaaggttttcggatcgtaaaactctgttgttagagaagaacaaggatgagagtaactgttcatcccttga<br>cggtatctaaccagaaagccacggctaactacgtgccagcagccgcggtaatacgtaggtggcaagcgttgtccggatttatt<br>gggcgtaaagcgagcgcaggcggtttcttaagtctgatgtgaaagcccccggctcaaccggggagggtcattggaaactgg<br>gagacttgagtgcagaagaggagagtggaattccatgtgtagcggtgaaatgcgtagatatatggaggaacaccagtggcga<br>aggcggctctctggtctgtaactgacgctgaggctcgaaagcgtggggagcaaacaggattagataccctggtagtccacgc<br>cgtaaacgatgagtgctaagtgttggagggtttccgccatca |
| *Clostridium _difficile* | SEQ ID NO: 2 | ttatgagagtttgatcctggctcaggacgaacgctggcggcgtgcctaatacatgcaagtcgaacgcttctttttccaccggagc<br>ttgctccaccggaaaaagaggagtggcgaacgggtgagtaacacgtgggtaacctgcccatcagaaggggataacacttgg<br>aaacaggtgctaataccgtataacaatcgaaaccgcatggttttgatttgaaaggcgctttcgggtgtcgctgatggatggaccc<br>gcggtgcattagctagttggtgaggtaacggctcaccaaggccacgatgcatagccgacctgagagggtgatcggccacatt<br>gggactgagacacggcccaaactcctacgggaggcagcagtagggaatcttcggcaatggacgaaagtctgaccgagcaa<br>cgccgcgtgagtgaagaaggttttcggatcgtaaaactctgttgttagagaagaacaaggatgagagtaactgttcatcccttga<br>cggtatctaaccagaaagccacggctaactacgtgccagcagccgcggtaatacgtaggtggcaagcgttgtccggatttatt<br>gggcgtaaagcgagcgcaggcggtttcttaagtctgatgtgaaagcccccggctcaaccggggagggtcattggaaactgg<br>gagacttgagtgcagaagaggagagtggaattccatgtgtagcggtgaaatgcgtagatatatggaggaacaccagtggcga<br>aggcggctctctggtctgtaactgacgctgaggctcgaaagcgtggggagcaaacaggattagataccctggtagtccacgc<br>cgtaaacgatgagtgctaagtgttggagggtttccgcccttca |
| *Clostridium _difficile* | SEQ ID NO: 3 | ttatgagagtttgatcctggctcaggacgaacgctggcggcgtgcctaatacatgcaagtcgaacgcttctttttccaccggagc<br>ttgctccaccggaaaaagaggagtggcgaacgggtgagtaacacgtgggtaacctgcccatcagaaggggataacacttgg<br>aaacaggtgctaataccgtataacaatcgaaaccgcatggttttgatttgaaaggcgctttcgggtgtcgctgatggatggaccc<br>gcggtgcattagctagttggtgaggtaacggctcaccaaggccacgatgcatagccgacctgagagggtgatcggccacatt<br>gggactgagacacggcccaaactcctacgggaggcagcagtagggaatcttcggcaatggacgaaagtctgaccgagcaa<br>cgccgcgtgagtgaagaaggttttcggatcgtaaaactctgttgttagagaagaacaaggatgagagtaactgttcatcccttga<br>cggtatctaaccagaaagccacggctaactacgtgce agcagccgcggtaatacgtaggtggcaagcgttgtccggatttatt<br>gggcgtaaagcgagcgcaggcggtttcttaagtctgatgtgaaagcccccggctcaaccggggagggtcattggaaactgg<br>gagacttgagtgcagaagaggagagtggaattccatgtgtagcggtgaaatgcgtagatatatggaggaacaccagtggcga<br>aggcggctctctggtctgtaactgacgctgaggctcgaaagcgtggggagcaaacaggattagataccctggtagtccacgc<br>cgtaaacgatgagtgctaagtgttggagggtttccgcccttca |
| *Fusicateniba cter_sacchar ivorans* | SEQ ID NO: 4 | tcagagagtttgatcctggctcaggatgaacgctggcggcgtgcttaacacatgcaagtcgagcgaagcagttaagttgatttct<br>tcggattgattcttgactgactgagcggcggacgggtgagtaacgcgtgggtgacctgccccataccgggggataacagctg<br>gaaacggctgctaataccgcataagcgcacagagctgcatggctcggtgtgaaaaactccggtggtatgggatgggcccgc<br>gtctgattaggcagttggcggggtaacggcccaccaaaccgacgatcagtagccggcctgagagggcgaccggccacattg<br>ggactgagacacggcccaaactcctacgggaggcagcagtggggaatattgcacaatgggggaaaccctgatgcagcgac<br>gccgcgtgagcgaagaagtatttcggtatgtaaagctctatcagcagggaagataatgacggtacctgactaagaagccccg<br>gctaactacgtgccagcagccgcggtaatacgtagggggcaagcgttatccggatttactgggtgtaaagggagcgtagacg<br>gcaaggcaagtctgatgtgaaaacccagggcttaaccctgggactgcattggaaactgtctggctcgagtgccggagaggta<br>agcggaattcctagtgtagcggtgaaatgcgtagatattaggaagaacaccagtggcgaaggcggcttactggacggtaact<br>gacgttgaggctcgaaagcgtggggagcaaacaggattagataccctggtagtccacgccgtaaacgatgaatgctaggtgtt |

TABLE 5-continued

Full length 16S rDNA sequences of species (negative correlates)

| Species Name | Sequence Identifier | 16S rDNA sequence |
|---|---|---|
| | | ggggagcaaagctcttcggtgccgccgcaaacgcattaagcattccacctggggagtacgttcgcaagaatgaaactcaaag<br>gaattgacggggacccgcacaagcggtggagcatgtggtttaattcgaagcaacgcgaagaaccttaccaggtcttgacatcc<br>cgatgaccggcccgtaacggggctttctcttcggagcattggagacaggtggtgcatggttgtcgtcagctcgtgtcgtgagat<br>gttgggttaagtcccgcaacgagcgcaacccttatcctcagtagccagcaggtaaagctgggcactctgtggagactgccag<br>ggataacctggaggaaggtggggatgacgtcaaatcatcatgccccttatgatctgggctacacacgtgctacaatggcgtaa<br>acaaagggaggcaaagccgcgaggtggagcaaatcccaaaaataacgtctcagttcggactgcagtctgcaactcgactgc<br>acgaagctggaatcgctagtaatcgcgaatcagaatgtcgcggtgaatacgttcccgggtcttgtacacaccgcccgtcacac<br>catgggagttggtaacgcccgaagtcagtgacccaacctttt aggagggagctgccgaaggcgggactgataactggggtg<br>aagtcgtaacaaggtagccgtatcggaaggtgcggctggatcacctccttt |
| *Lachnospira _pectinoschi za* | SEQ ID NO: 5 | ttatgagagtttgatcctggctcaggatgaacgctggcggcgtgcttaacacatgcaagtcgaacgaagcatttaagacagatta<br>cttcggtttgaagtcttttatgactgagtggcggacgggtgagtaacgcgtgggtaacctgcctcatacaggggggatagcagct<br>ggaaacggctggtaataccgcataagcgcacagtaccacatggtacagtgtgaaaaactccggtggtatgagatggacccgc<br>gtctgattagcttgttggcggggtaacggcccaccaaggcgacgatcagtagccgacctgagagggtgaccggccacattgg<br>gactgagacacggcccagactcctacgggaggcagcagtggggaatattgcacaatggaggaaactctgatgcagcgacg<br>ccgcgtgagtgaagaagtagttcgctatgtaaagctctatcagcagggaagatagtgacggtacctgactaagaagctccggc<br>taaatacgtgccagcagccgcggtaatacgtatggagcaagcgttatccggatttactgggtgtaaagggagtgtaggtggcc<br>aggcaagtcagaagtgaaagcccggggctcaaccccgggactgcttttgaaactgcagggctagagtgcaggaggggcaa<br>gtggaattcctagtgtagcggtgaaatgcgtagatattaggaggaacaccagtggcgaaggcggcttgctggactgtaactga<br>cactgaggctcgaaagcgtggggagcaaacaggattagataccctggtagtccacgccgtaaacgatgaatactaggtgtcg<br>gggcacataagtgctccggtgccgcagcaaacgcaataagtattccacctggggagtacgttcgcaagaatgaaactcaaag<br>gaattgacggggacccgcacaagcggtggagcatgtggtttaattcgaagcaacgcgaagaaccttaccaagtcttgacatcc<br>tcttgaccggtcagtaatgtgaccttttcttcggaacaagagtgacaggtggtgcatggttgtcgtcagctcgtgtcgtgagatgtt<br>gggttaagtcccgcaacgagcgcaacccttatccttagtagccagcagttcggctgggcactctagggagactgccagggat<br>aacctggaggaaggtggggatgacgtcaaatcatcatgccccttatgacttgggctacacacgtgctacaatggcgtaaacaa<br>agtgaagcgagagcgtgagcttaagcaaatcacaaaaataacgtctcagttcggattgtagtctgcaactcgactacatgaagc<br>tggaatcgctagtaatcgcagatcagaatgctgcggtgaatacgttcccgggtcttgtacacaccgcccgtcacaccatggga<br>gtcggaaatgcccgaagtcggtgacctaacgtaagaaggagccgccgaaggcaggtctgataactggggtgaagtcgtaac<br>aaggtagccgtatcggaaggtgcggctggatcacctccttt |
| *Clostridium _sp.* | SEQ ID NO: 6 | tccggtggtatgagatggacccgcgtctgattagctagttggtgaggtaacggcccaccaaggcgacgatcagtagccgacct<br>gagagggtgaccggccacattgggactgagacacggcccagactcctacgggaggcagcagtgggggatattgcacaatg<br>gaggaaactctgatgcagcgacgccgcgtgagtgaagaagtatttcggtatgtaaagctctatcagcagggaagaaaatgac<br>ggtacctgactaagaagccccggctaactacgtgccagcagccgcggtaatacgtagggggcaagcgttatccggatttact<br>gggtgtaaagggagcgtagacggcgacgcaagtctgaagtgaaatacccgggctcaacctgggaactgctttggaaactgtg<br>ttgctagagtgctggagaggtaagcggaattcctagtgtagcggtgaaatgcgtagatattaggaagaacaccagtggcgaag<br>gcggcttactggacagtaactgacgttgaggctcgaaagcgtggggagcaaacaggattagataccctggtagtccacgccg<br>taaacgatgaatactaggtgttggtgagcaaagctcatcggtgccgccgcaaacgcaataagtattccacctggggagtacgtt<br>cgcaagaatgaaactcaaaggaattgacggggacccgcacaagcggtggagcatgtggtttaattcgaagcaacgcgaaga<br>accttaccaaatcttgacatccctctgaaaagcctttaatcgggctcctccttcgggacagaggtgacaggtggtgcatggttgtc<br>gtcagctcgtgtcgtgagatgttgggttaagtcccgcaacgagcgcaacccctattgtcagtagccagcaggtaaagctgggc<br>actctgatgagactgccagggataacctggaggaaggtggggatgacgtcaaatcatcatgccccttatgatttgggctacaca<br>cgtgctacaatggcgtaaacaaagagaagcgagcctgcgaggggggagcaaatctcaaaaataacgtctcagttcggattgta<br>gtctgcaactcgactacatgaagctggaatcgctagtaatcgcagatcagaatgctgcggtgaatacgttcccgggtcttgtaca<br>caccgcccgtcacaccatgggagtcggaaatgcccgaagccagtgacccaagcgaaagcagggagctgtcgaaggcagg<br>tctgataactggggtgaagtcgtaacaaggtagccgtatcggaaggtgcggctggatcacctccttt |

TABLE 5-continued

| Full length 16S rDNA sequences of species (negative correlates) | | |
|---|---|---|
| Species Name | Sequence Identifier | 16S rDNA sequence |
| *Ruminococcus_sp.* | SEQ ID NO: 7 | tacgagagtttgatcctggctcaggatgaacgctggcggcgtgcttaacacatgcaagtcgaacgaagcacttaagtttgattct<br>tcggatgaagacttttgtgactgagtggcggacgggtgagtaacgcgtgggtaacctgcctcatacagggggataacagttag<br>aaatggctgctaataccgcataagaccacagcaccgcatggtgcaggggtaaaaactccggtggtatgagatggacccgcgt<br>ctgattagctggttggtggggtaacggcctaccaaggcgacgatcagtagccgacctgagagggtgaccggccacattggg<br>actgagacacggcccaaactcctacgggaggcagcagtggggaatattgcacaatgggggaaaccctgatgcagcgacgc<br>cgcgtgaaggatgaagtatttcggtatgtaaacttctatcagcagggaagaaaatgacggtacctgactaagaagccccggct<br>aactacgtgccagcagccgcggtaatacgtagggggcaagcgttatccggatttactgggtgtaaagggagcgtagacggta<br>tggcaagtctgatgtgaaaggccagggctcaaccctgggactgcattggaaactgtcgaactagagtgtcggagaggcaagt<br>ggaattcctagtgtagcggtgaaatgcgtagatattaggaggaacaccagtggcgaaggcggcttgctggacgatgactgac<br>gttgaggctcgaaagcgtggggagcaaacaggattagataccctggtagtccacgccgtaaacgatgactactaggtgtcgg<br>gtagcagagctattcggtgccgcagccaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatctccc<br>tgaccggcaagtaatgttgcctttccttcgggacagggatgacaggtggtgcatggttgtcgtcagctcgtgtcgtgagatgttg<br>ggttaagtcccgcaacgagcgcaacccctatctttagtagccagcggtacggccgggcactctagagagactgccagggata<br>acctggaggaaggtggggatgacgtcaaatcatcatgccccttatgagcagggctacacacgtgctacaatggcgtaaacaa<br>agggaagcgagcctgcgagggtaagcaaatctcaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gttggtaacgcccgaagtcagtgacccaaccgcaaggagggagctgccgaaggtgggaccgataactggggtgaagtcgt<br>aacaaggtagccgtatcggaaggtgcggctggatcacctccttt |
| *Clostridium_sp.* | SEQ ID NO: 8 | tttagagagtttgatcctggctcaggatgaacgctggcggcgtgcttaacacatgcaagtcgagcgaagcacttatggagattct<br>tcggatgatccatttgtgactgagcggcggacgggtgagtaacgcgtgagtaacctgcctcatacaggggaataacagttaga<br>aatgactgctaatgccgcataagcgcacagggccacatggcctggtgtgaaaaactccggtggtatgagatggactcgcgtct<br>gattagctagttggtgaggtaacggcccaccaaggcgacgatcagtagccggcctgagagggtgaacggccacattgggac<br>tgagacacggcccaaactcctacgggaggcagcagtggggaatattgcacaatgggggaaaccctgatgcagcgacgccg<br>cgtgagtgaagaagtatttcggtatgtaaagctctatcagcagggaagaaaatgacggtacctgactaagaagccccggctaa<br>ctacgtgccagcagccgcggtaatacgtagggggcaagcgttatccggatttactgggtgtaaagggagcgtagacggctttg<br>caagtctgacgtgaaaatccggggctcaaccccggaactgcgttggaaactgtgaggcttgagtgccggagaggtaagcgg<br>aattcctagtgtagcggtgaaatgcgtagatattaggaggaacaccagtggcgaaggcggcttactggacggcaactgacgtt<br>gaggctcgaaagcgtggggagcaaacaggattagataccctggtagtccacgcggtaaacgatgaatactaggtgttgggg<br>gacaaagtccttcggtgccgccgcaaacgcattaagtattccacctggggagtacgttcgcaagaatgaaactcaaaggaatt<br>gacggggacccgcacaagcggtggagcatgtggtttaattcgaagcaacgcgaagaaccttaccaagtcttgacatcgattcg<br>ccgggactgtaatgagtcctttcccttcggggacgaagaagacaggtggtgcatggttgtcgtcagacgtgtcgtgagatgtt<br>gggttaagtcccgcaacgagcgcaacccttatcttcagtagccagcaagtgaagttgggcactctggagagactgccaggga<br>caacctggaggaaggtggggatgacgtcaaatcatcatgccccttatgacttgggctacacacgtgctacaatggcgtaaaca<br>aagggaagcagccctgtgaaggtgagcaaatcccaaaaataacgtctcagttcggattgtagtctgcaactcgactacatgaa<br>gctggaatcgctagtaatcgcgaatcagaatgtcgcggtgaatacgttcccgggtcttgtacacaccgcccgtcacaccatgg<br>gagtcggtaacgcccgaagtcagtgacccaaccgaaaggagggagctgccgaaggcgggactggtaactggggtgaagt<br>cgtaacaaggtagccgtatcggaaggtgcggctggatcacctccttt |
| *Blautia_faecis* | SEQ ID NO: 9 | ctccggtggtataagatggacccgcgttggattagctagttggcagggcagcggcctaccaaggcgacgatccatagccggc<br>ctgagagggtgaacggccacattgggactgagacacggcccagactcctacgggaggcagcagtggggaatattgcacaat<br>gggggaaaccctgatgcagcgacgccgcgtgaaggaagaagtatctcggtatgtaaacttctatcagcagggaagataatga<br>cggtacctgactaagaagccccggctaactacgtgccagcagccgcggtaatacgtagggggcgagcgttatccggatttac<br>tgggtgtaaagggagcgtagacggcgtatcaagtctgatgtgaaaggcaggggcttaacccctggactgcattggaaactggt<br>atgcttgagtgccggaggggtaagcggaattcctagtgtagcggtgaaatgcgtagatattaggaggaacaccagtggcgaa<br>ggcggcttactggacggtaactgacgttgaggctcgaaagcgtggggagcaaacaggattagataccctggtagtccacgcc |

TABLE 5-continued

Full length 16S rDNA sequences of species (negative correlates)

| Species Name | Sequence Identifier | 16S rDNA sequence |
|---|---|---|
| | | gtaaacgatgaatactaggtgtctgggagcacagctcttaggtgccgccgcaaacgcattaagtattccacctggggagtacgt tcgcaagaatgaaactcaaaggaattgacggggacccgcacaagcggtggagcatgtggtttaattcgaagcaacgcgaag aaccttaccaaatcttgacatccctctgacagagtatgtaatgtacttttccttcgggacaggggagacaggtggtgcatggttgt cgtcagctcgtgtcgtgagatgttgggttaagtcccgcaacgagcgcaacccctatccttagtagccagcaagtaatgttgggc actctgaggagactgccagggataacctggaggaaggcggggatgacgtcaaatcatcatgccccttatgatttgggctacac acgtgctacaatggcgtaaacaaagggaagcgaacctgtgagggtgggcaaatctcaaaaataacgtcccagttcggactgc agtctgcaactcgactgcacgaagctggaatcgctagtaatcgcggatcagaatgccgcggtgaatacgttcccgggtcttgta cacaccgcccgtcacaccatgggagtcagtaacgcccgaagtcagtgacctaaccgtaaggaaggagctgccgaaggcgg gacggatgactggggtgaagtcgtaacaaggtagccgtatcggaaggtgcggctggatcacctccttt |
| *Clostridium* _sp. | SEQ ID NO: 10 | taaagagtttgatcctggctcaggacgaacgctgtcggcgcgcctaacacatgcaagtcgaacgaagttgctttgaatgaattct tcggaaggaatttgattcaacttagtggcggacgggtgagtaacgcgtgagtaacctgcctttcagaggggataacgtctgg aaacggacgctaataccgcataacatattggtttcgcatggagctgatatcaaaggagcaatccgctgaaagatggactcgcgt ccaattagctagttggtgaggtaacggcccaccaaggcgacgattggtagccggactgagaggttgaacggccacattggga ctgagacacggcccagactcctacgggaggcagcagtggggaatattgcacaatgggggaaaccctgatgcagcgacgcc gagtgagggaagaaggttttcggattgtaaacctctgtccttggtgaagataatgacggtaaccaaggaggaagctacggcta actacgtgccagcagccgcggtaatacgtaggtagcgagcgttgtccggaattactgggtgtaaagggagcgtaggcgggat tgcaagttgaatgttaaatctatgggctcaacccatagccgcgttcaaaactgcagttcttgagtgaagtagaggcaggcggaat tcctagtgtagcggtgaaatgcgtaaatattaggaggaacaccagtggcgaaggcggcctgctgggctttaactgacgctgag gctcgaaagcgtgggtagcaaacaggattagataccctggtagtccacgctgtaaacgatgattactaggtgtgggggggactg accccttccgtgccggagttaacacaataagtaatccacctggggagtacgaccgcaaggttgaaactcaaaggaattgacgg gggcccgcacaagcagtggagtatgtggtttaattcgaagcaacgcgaagaaccttaccaggtcttgacatccggtgcatagc ctagagataggtgaagcccttcggggcaccgagacaggtggtgcatggttgtcgtcagctcgtgtcgtgagatgttgggttaa gtcccgcaacgagcgcaacccttacgtttagttgctacgcaagagcactctagacggactgccgttgacaaaacggaggaag gtggggatgacgtcaaatcatcatgccccttatgacctgggctacacacgtactacaatggctattaacagagggaagcaagat ggtgacatggagcaaacccctaaaaatagtctcagttcggattgcaggctgcaacccgcctgcatgaagccggaattgctagt aatcgcggatcagcatgccgcggtgaatacgttcccgggccttgtacacaccgcccgtcacaccatgagagttggcaacacc cgaagccgatagtctaaccgcaaggggggacgtcgtcgaaggtggggttgatgattggggtgaagtcgtaacaaggtagccgt atcggaaggtgcggctggatcacctccttt |
| *Clostridium* _sp. | SEQ ID NO: 11 | atgagagtttgatcctggctcaggatgaacgctggcggcgtgcctaacacatgcaagtcgaacggaatttacatgaagcctag cgattgtaaatttagtggcggacgggtgagtaacgcgtgggtaacctgccttgtactgggggacaacagttggaaacgactgc taataccgcataagcgcacagcttcgcatgaagcagtgtgaaaaactccggtggtacaagatggacccgcgtctgattagctg gttggtgaggtaacggcccaccaaggcgacgatcagtagccggcctgagagggtgaacggccacattgggactgagacac ggcccaaactcctacgggaggcagcagtggggaatattgcacaatgggggaaaccctgatgcagcaacgccgcgtgagtg aagaagtatttcggtatgtaaagctctatcagcaggaaagaaaatgacggtacctgactaagaagccccggctaactacgtgcc agcagccgcggtaatacgtagggggcaagcgttatccggatttactgggtgtaaagggagcgtagacggttttgcaagtctga agtgaaagcccggggcttaaccccgggactgctttggaaactgtaggactagagtgcaggagaggtaagtggaattcctagt gtagcggtgaaatgcgtagatattaggaggaacaccagtggcgaaggcggcttactggactgtaactgacgttgaggctcga aagcgtggggagcaaacaggattagataccctggtagtccacgccgtaaacgatgattactaggtgttggtgggtacgaccca tcggtgccgcagcaaacgcaataagtaatccacctggggagtacgttcgcaagaatgaaactcaaaggaattgacggggacc cgcacaagcggtggagcatgtggtttaattcgaagcaacgcgaagaaccttacctggtcttgacatccctatgaataacgggca atgccgttagtacttcggtacataggagacaggtggtgcatggttgtcgtcagctcgtgtcgtgagatgttgggttaagtcccgc aacgagcgcaacccttatctttagtagccagcagtaagatgggcactctagagagactgccggggataacccggaggaaggt ggggatgacgtcaaatcatcatgccccttatgaccagggctacacacgtgctacaatggcgtaaacaaagagaagcgaagtc gtgaggcagagcgaatctcaaaaataacgtctcagttcggattgtagtctgcaactcgactacatgaagctggaatcgctagta atcgcagatcagaatgctgcggtgaatacgttcccgggtcttgtacacaccgcccgtcacaccatgggagtcggaaatgcccg |

TABLE 5-continued

| Full length 16S rDNA sequences of species (negative correlates) | | |
|---|---|---|
| Species Name | Sequence Identifier | 16S rDNA sequence |
| | | aagtcggtgacctaaccgaaaggaaggagccgccgaaggcaggtctgataactggggtgaagtcgtaacaaggtagccgta tcggaaggtgcggctggatcacctccttt |
| *Clostridium _sp.* | SEQ ID NO: 12 | atgagagtttgatcctggctcaggatgaacgctggcggcgtgcctaacacatgcaagtcgaacgaggtattttgattgaagtttt cggatggatttcaagataccgagtggcggacgggtgagtaacgcgtgggtaacctgcctcatacaggggggataacggttaga aatgactgctaataccgcataagcgcacagtaccgcatggtacggtgtgaaaaactccggtggtatgagatggacccgcgtct gattagctagttggtggggtaacggcccaccaaggcgacgatcagtagccgacctgagagggtgaccggccacattgggac tgagacacggcccagactcctacgggaggcagcagtgggggatattgcacaatggaggaaactctgatgcagcgacgccg cgtgagtgaagaagtatttcggtatgtaaagctctatcagcagggaagaaaatgacggtacctgactaagaagccccggctaa ctacgtgccagcagccgcggtaatacgtagggggcaagcgttatccggatttactgggtgtaaagggagcgtagacggcga cgcaagtctgaagtgaaatacccgggctcaacctgggaactgctttggaaactgtgttgctagagtgctggagaggtaagcgg aattcctagtgtagcggtgaaatgcgtagatattaggaagaacaccagtggcgaaggcggcttactggacagtaactgacgtt gaggctcgaaagcgtggggagcaaacaggattagataccctggtagtccacgccgtaaacgatgaatactaggtgttggtga gcaaagctcatcggtgccgccgcaaacgcaataagtattccacctggggagtacgttcgcaagaatgaaactcaaaggaattg acggggacccgcacaagcggtggagcatgtggtttaattcgaagcaacgcgaagaaccttaccaaatcttgacatccctctga aannnnnnnnnnnnnnnnnnnnnnnnnnnnnnnnnnnnnnnnnnnnnnncctccttcgggacagaggtgacagg tggtgcatggttgtcgtcagctcgtgtcgtgagatgttgggttaagtcccgcaacgagcgcaacccctattgtcagtagccagca ggtaaagctgggcactctgatgagactgccagggataacctggaggaaggtggggatgacgtcaaatcatcatgccccttatg atttgggctacacacgtgctacaatggcgtaaacaaagagaagcgagcctgcgaggggggagcaaatctcaaaaataacgtct cagttcggattgtagtctgcaactcgactacatgaagctggaatcgctagtaatcgcagatcagaatgctgcggtgaatacgttc ccgggtcttgtacacaccgcccgtcacaccatgggagtcggaaatgcccgaagccagtgacccaagcgaaagcagggagc tgtcgaaggcaggtctgataactggggtgaagtcgtaacaaggtagccgtatcggaaggtgcggctggatcacctccttt |
| *Flavonifractor_sp.* | SEQ ID NO: 13 | tattgagagtttgatcctggctcaggatgaacgctggcggcgtgcttaacacatgcaagtcgaacggagtgctcatgacagag gattcgtccaatggagtgagttacttagtggcggacgggtgagtaacgcgtgagtaacctgccttggagtggggaataacagg tggaaacatctgctaataccgcatgatgcagttgggtcgcatggctctgactgccaaagatttatcgctctgagatggactcgcg tctgattagctggttggcggggtaacggcccaccaaggcgacgatcagtagccggactgagaggttggccggccacattgg gactgagacacggcccagactcctacgggaggcagcagtggggaatattgggcaatgggcgcaagcctgacccagcaac gccgcgtgaaggaagaaggctttcgggttgtaaacttcttttctcagggacgaagcaagtgacggtacctgaggaataagcca cggctaactacgtgccagcagccgcggtaatacgtaggtggcgagcgttatccggatttactgggtgtaaagggcgtgtaggc gggactgcaagtcagatgtgaaaaccatgggctcaacctgtggcctgcatttgaaactgtagttcttgagtactggagaggcag acggaattcctagtgtagcggtgaaatgcgtagatattaggaggaacaccagtggcgaaggcggtctgctggacagcaactg acgctgaggcgcgaaagcgtggggagcaaacaggattagataccctggtagtccacgctgtaaacgatggatactaggtgtg gggggtctgacccctccgtgccgcagttaacacaataagtatcccacctggggagtacgatcgcaaggttgaaactcaaag gaattgacgggggcccgcacaagcggtggagtatgtggtttaattcgaagcaacgcgaagaaccttaccaggcttgacatc ccggtgaccggtgtagagatacaccttcttcttcggaagcgccggtgacaggtggtgcatggttgtcgtcagctcgtgtcgtga gatgttgggttaagtcccgcaacgagcgcaacccttattgttagttgctacgcaagagcactctagcgagactgccgttgacaa aacggaggaaggtggggacgacgtcaaatcatcatgccccttatgtcctgggccacacacgtactacaatggtggtcaacag agggaagcaagaccgcgaggtggagcaaacccctaaaagccatcccagttcggattgcaggctgcaactcgcctgtatgaa gttggaatcgctagtaatcgcggatcagcatgccgcggtgaatacgttcccgggccttgtacacaccgcccgtcacaccatga gagtcgggaacacccgaagtccgtagcctaaccgcaagggggcgcggccgaaggtgggttcgataattggggtgaagtc gtaacaaggtagccgtatcggaaggtgcggctggatcacctccttt |
| *Emergencia _timonensis* | SEQ ID NO: 14 | attaagagtttgatcctggctcaggatgaacgctggcggcgtgcctaacacatgcaagtcgagcgagaagccattgaccgata cttcggtaaagggatatggcggaaagcggcggacgggtgagtaacgcgtaggcaacctgccccttacagagggatagccat tggaaacgatgattaagacctcataacgcctccctcccacatgagggggaggccaaagattcatcggtaagggatgggcctg cgtctgattagcttgttggcggggtaacggcccaccaaggcgacgatcagtagccgacctgagagggtgatcggccacattg gaactgagacacggtccaaactcctacgggaggcagcagtggggaatattgcacaatgggcggaagcctgatgcagcaac |

TABLE 5-continued

| Full length 16S rDNA sequences of species (negative correlates) | | |
|---|---|---|
| Species Name | Sequence Identifier | 16S rDNA sequence |
| | | gccgcgtgagggatgaaggccttcgggtcgtaaacctctgtccttggggaagaaacaaatgacggtacccatggaggaagc<br>cccggctaactacgtgccagcagccgcggtaatacgtagggggcgagcgttatccggaattattgggcgtaaagagtgcgta<br>ggtggttacctaagcgcagggtctaaggcaatggctcaaccattgttcgccctgcgaactgggctacttgagtgcaggagagg<br>aaagcggaattcctagtgtagcggtgaaatgcgtagatattaggaggaacaccagtggcgaaggcggctttctggactgttact<br>gacactgaggcacgaaagcgtggggagcaaacaggattagataccctggtagtccacgccgtaaacgatgagcactaggtg<br>tcggggccgcaaggcttcggtgccgcagttaacgcattaagtgctccgcctggggagtacgcacgcaagtgtgaaactcaaa<br>ggaattgacggggacccgcacaagcagcggagcatgtggtttaattcgaagcaacgcgaagaaccttaccaggacttgacat<br>ccccctgacagatccttaaccggatccttcttcggacaggggagacaggtggtgcatggttgtcgtcagctcgtgtcgtgagat<br>gttgggttaagtcccgcaacgagcgcaacccttgccattagttgccatcattcagttgggcactctaatgggactgccggggac<br>aactcggaggaaggtggggatgacgtcaaatcatcatgccccttatgttctgggctacacacgtgctacaatggccggtacag<br>caggaagcgatcccgcgagggggagcaaatcccaaaaaccggtcccagttcggactgcaggctgcaacccgcctgcacga<br>agccggagttgctagtaatcgtggatcagaatgccacggtgaatgcgttcccgggtcttgtacacaccgcccgtcacaccatg<br>gaagttgggggtgcccgaagccggcagggagatatgctgtctaaggcaaaaccaatgactggggtgaagtcgtaacaaggt<br>agccgtatcggaaggtgcggctggatcacctccttt |
| *Clostridium* _sp. | SEQ ID NO: 15 | atgagagtttgatcctggctcaggatgaacgctggcggcgtgcctaacacatgcaagtcgaacgaggtaaatgagatgaagtt<br>ttcggatggattcttatttaccgagtggcggacgggtgagtaacgcgtgggtaacctgcctcatacaggggggataacgattgga<br>aacgattgctaataccgcataagcgcacagtaccacatggtacagtgtgaaaaactccggtggtatgagatggacccgcgtct<br>gattagctagttggtgaggtaacggcccaccaaggcaacgatcagtagccgacctgagagggtgaccggccacattgggac<br>tgagacacggcccagactcctacgggaggcagcagtgggggatattgcacaatggaggaaactctgatgcagcgacgccg<br>cgtgagtgaagaagtatttcggtatgtaaagctctatcagcagggaagaaaatgacggtacctgactaagaagccccggctaa<br>ctacgtgccagcagccgcggtaatacgtagggggcaagcgttatccggatttactgggtgtaaagggagcgtagacggcgat<br>gcaagtctgaagtgaaatacccgggctcaacctgggaactgctttggaaactgtatggctagagtgctggagaggtaagcgg<br>aattcctagtgtagcggtgaaatgcgtagatattaggaagaacaccagtggcgaaggcggcttactggacagtaactgacgttc<br>aggctcgaaagcgtggggagcaaacaggattagataccctggtagtccacgccgtaaacgatgaatactaggtgtcggggg<br>acaaagtctttcggtgccgccgcaaacgcaataagtattccacctggggagtacgttcgcaagaatgaaactcaaaggaattga<br>cggggacccgcacaagcggtggagcatgtggtttaattcgaagcaacgcgaagaaccttaccaaatcttgacatccctctgaa<br>aagcctttaatcgggctcctccttcgggacagaggtgacaggtggtgcatggttgtcgtcagctcgtgtcgtgagatgttgggtt<br>aagtcccgcaacgagcgcaacccctattgtcagtagccagcaggtaaagctgggcactctgatgagactgccagggataacc<br>tggaggaaggtggggatgacgtcaaatcatcatgccccttatgatttgggctacacacgtgctacaatggcgtaaacaaagag<br>aggcgaagctgtgaggcagagcaaatctcaaaaataacgtctcagttcggattgtagtctgcaactcgactacatgaagctgga<br>atcgctagtaatcgcggatcagaatgccgcggtgaatacgttcccgggtcttgtacacaccgcccgtcacaccatgggagtcg<br>gaaatgcccgaagccagtgacccaagcgaaagcagggagctgtcgaaggcaggtctgataactggggtgaagtcgtaaca<br>aggtagccgtatcggaaggtgcggctggatcacctccttt |
| *Clostridium* _sp. | SEQ ID NO: 16 | nccggatttactgggtgtaaagggtgcgtaggcggaactgcaagtcagtggtgaaatctgagggctcaaccctcaaactgcca<br>ttgaaactgtggttcttgagtgaagtagaggtaggcggaattcccggtgtagcggtggaatgcgtagagatcgggaggaacac<br>cagtggcgaaggcggcctactgggctttaactgacgctgaggcacgaaagcatgggtagcaaacaggattagataccctggt<br>agtccatgccgtaaacgatgattactaggtgtgggggggtctgacccccctccgtgccggagttaacacaataagtaatccacctg<br>gggagtacggccgcaaggttgaaactcaaaggaattgacgggggcccgcacaagcagtggagtatgtggtttaattcgacgc<br>aacgcgaagaaccttaccaggtcttgacatccaactaacgaggtagagatacgtcaggtgcccttcggggaaagttgagaca<br>ggtggtgcatggttgtcgtcagctcgtgtcgtgagatgttgggttaagtcccgcaacgagcgcaacccttgtgattagttgctac<br>gcaagagcactctaatcagactgccgttgacaaaacggaggaaggtggggatgacgtcaaatcatcatgccctttatgacctg<br>ggctacacacgtactacaatggccgtaaacagagagaggcgacaccgcgaggtgaagcgaaaccctaaaaacggtctcagt<br>tcggattgtaggctgcaacccgcctacatgaagttggaattgctagtaatcgcggatcagcatgccgcggtgaatacgttcccg<br>ggccttgtacacaccgcccgtcacaccatgggagccggtaatacccgaagtcagtagtctaaccgcaagggggggcgctgcc<br>gaaggtaggattggcgactggggtgaagtcgtaacaaggtagccgtatcggaaggtgcggctggatcacctccttt |

TABLE 5-continued

| Full length 16S rDNA sequences of species (negative correlates) | | |
|---|---|---|
| Species Name | Sequence Identifier | 16S rDNA sequence |
| *Clostridium* _sp. | SEQ ID NO: 17 | acggcccagactcctacgggaggcagcagtggggaatattgcgcaatgggggaaaccctgacgcagcaacgccgcgtgat<br>tgaagaaggccttcgggttgtaaagatctttaattagggacgaaataaatgacggtacctgaagaataagctccggctaactac<br>gtgccagcagccgcggtaatacgtagggagcaagcgttatccggatttactgggtgtaaagggcgcgcaggcgggccggta<br>agttggaagtgaaatctatggcttaacccataaactgctttcaaaactgctggtcttgagtgatggagaggcaggcggaattcc<br>gtgtgtagcggtgaaatgcgtagatatacggaggaacaccagtggcgaaggcggcctgctggacattaactgacgctgagg<br>cgcgaaagcgtggggagcaaacaggattagataccctggtagtccacgccgtaaacgatggatactaggtgtgggaggtatt<br>gaccccttccgtgccgcagttaacacaataagtatcccacctggggagtacggccgcaaggttgaaactcaaaggaattgacg<br>gggcccgcacaagcagtggagtatgtggtttaattcgaagcaacgcgaagaaccttaccaggtcttgacatcccgatgaccg<br>nctttcttcggaacatcggtgacaggtggtgcatggttgtcgtcagctcgtgtcgtgagatgttgggttaagtcccgcaacgag<br>cgcaacccttacggttagttgatacgcaagatcactctagccggactgccgttgacaaaacggaggaaggtggggacgacgt<br>caaatcatcatgccccttatgacctgggctacacacgtactacaatggcagtcatacagagggaagcaaaaccgcgaggtgg<br>agcaaatccctaaaagctgtcccagttcagattgcaggctgcaacccgcctgcatgaagtcggaattgctagtaatcgcggatc<br>agcatgccgcggtgaatacgttcccgggccttgtacacaccgcccgtcacaccatgagagccgtcaatacccgaagtccgta<br>gcctaac |
| *Clostridium* _sp. | SEQ ID NO: 18 | tttagagagtttgatcctggctcaggatgaacgctggcggcgtgcctaacacatgcaagtcgaacggggttattttggaaatctc<br>ttcggagatggaattcttaacctagtggcggacgggtgagtaacgcgtgagcaatctgcctttaggagggggataacagtcgg<br>aaacggctgctaataccgcataatacgtttgggaggcatctcttgaacgtcaaagattttatcgcctttagatgagctcgcgtctg<br>attagctggttggcggggtaacggcccaccaaggcgacgatcagtagccggactgagaggttgaacggccacattgggact<br>gagacacggcccagactcctacgggaggcagcagtggggaatattgcgcaatgggggaaaccctgacgcagcaacgccg<br>cgtgattgaagaaggccttcgggttgtaaagatctttaatcagggacgaaaaatgacggtacctgaagaataagctccggctaa<br>ctacgtgccagcagccgcggtaatacgtagggagcaagcgttatccggatttactgggtgtaaagggcgcgcaggcgggcc<br>ggcaagttgggagtgaaatcccggggcttaaccccggaactgctttcaaaactgctggtcttgagtgatggagaggcaggcg<br>gaattccgtgtgtagcggtgaaatgcgtagatatacggaggaacaccagtggcgaaggcggcctgctggacattaactgacg<br>ctgaggcgcgaaagcgtggggagcaaacaggattagataccctggtagtccacgccgtaaacgatggatactaggtgtggg<br>aggtattgaccccttccgtgccgcagttaacacaataagtatcccacctggggagtacggccgcaaggttgaaactcaaagga<br>attgacgggggcccgcacaagcagtggagtatgtggtttaattcgaagcaacgcgaagaaccttaccaggtcttgacatcccg<br>atgaccggcgtagagatacgccctctcttcggagcatcggtgacaggtggtgcatggttgtcgtcagctcgtgtcgtgagatgtt<br>gggttaagtcccgcaacgagcgcaacccttacggttagttgatacgcaagatcactctagccggactgccgttgacaaaacgg<br>aggaaggtggggacgacgtcaaatcatcatgccccttatgacctgggctacacacgtactacaatggcagtcatacagaggg<br>aagcaataccgcgaggtggagcaaatccctaaaagctgtcccagttcagattgcaggctgcaacccgcctgcatgaagtcgg<br>aattgctagtaatcgcggatcagcatgccgcggtgaatacgttcccgggccttgtacacaccgcccgtcacaccatgagagcc<br>gtcaatacccgaagtccgtagcctaaccgcaagggggcgcggccgaaggtaggggtggtaattagggtgaagtcgtaaca<br>aggtagccgtatcggaaggtgcggctggatcacctccttt |
| *Flavonifract or*_sp. | SEQ ID NO: 19 | tattgagagtttgatcctggctcaggatgaacgctggcggcgtgcttaacacatgcaagtcgaacggagtgcccatgacagag<br>gattcgtccaatggattgggttacttagtggcggacgggtgagtaacgcgtgaggaacctgcctcggagtggggaataacaca<br>acgaaagctgtgctaataccgcatgatacagttgggtcgcatgactctgactgtcaaagatttatcgctctgagatggcctcgcg<br>tctgattagctagttggtggggtaacggcccaccaaggcgacgatcagtagccggactgagaggttgaccggccacattggg<br>actgagacacggcccagactcctacgggaggcagcagtggggaatattgggcaatgggcgcaagcctgacccagcaacgc<br>cgcgtgaaggaagaaggctttcgggttgtaaacttcttttctcagggacgaagcaagtgacggtacctgaggaataagccacg<br>gctaactacgtgccagcagccgcggtaatacgtaggtggcaagcgttatccggatttactgggtgtaaagggcgtgtaggcgg<br>gatcgcaagtcagatgtgaaaactggaggctcaacctccagcctgcatttgaaactgtggttcttgagtactggagaggcagac<br>ggaattcctagtgtagcggtgaaatgcgtagatattaggaggaacaccagtggcgaaggcggtctgctggacagcaactgac<br>gctgaggcgcgaaagcgtggggagcaaacaggattagataccctggtagtccacgctgtaaacgatggatactaggtgtgg<br>ggggtctgacccccctccgtgccgcagttaacacaataagtatcccacctggggagtacgatcgcaaggttgaaactcaaagga<br>attgacgggggcccgcacaagcggtggagtatgtggtttaattcgaagcaacgcgaagaaccttaccagggcttgacatccc<br>gaggcccggcctagagataggcctttctcttcggagacctcggtgacaggtggtgcatggttgtcgtcagctcgtgtcgtgaga |

TABLE 5-continued

Full length 16S rDNA sequences of species (negative correlates)

| Species Name | Sequence Identifier | 16S rDNA sequence |
|---|---|---|
| | | tgttgggttaagtcccgcaacgagcgcaacccctattgttagttgctacgcaagagcactctagcgagactgccgttgacaaaa<br>cggaggaaggtggggacgacgtcaaatcatcatgccccttatgtcctgggccacacacgtactacaatggtggttaacagag<br>ggaggcaagaccgtgaggtggagcaaatccctaaaagccatcccagttcggattgcaggctgcaacccgcctgcatgaagtt<br>ggaatcgctagtaatcgcggatcagcatgccgcggtgaatacgttcccgggccttgtacacaccgcccgtcacaccatgaga<br>gtcgggaacacccgaagtccgtagcctaacagcaatgggggcgcggccgaaggtgggttcgataattggggtgaagtcgta<br>acaaggtagccgtatcggaaggtgcggctggatcacctccttt |
| *Intestinimonas_massiliensis* | SEQ ID NO: 20 | tattgagagtttgatcctggctcaggatgaacgctggcggcgtgcttaacacatgcaagtcgaacggaacgccaaggaaaga<br>gttttcggacaatggaattggctgtttagtggcggacgggtgagtaacgcgtgagtaacctgccttggagtggggaataacaca<br>gtgaaaactgtgctaataccgcatgacatattggtgtcgcatggcactgatatcaaagatttatcgctctgagatggactcgcgtc<br>tgattagatagttggcggggtaacggcccaccaagtcgacgatcagtagccggactgagaggttggccggccacattgggac<br>tgagacacggcccagactcctacgggaggcagcagtggggaatattgggcaatgggcgcaagcctgacccagcaacgcc<br>gcgtgaaggaagaaggctttcgggttgtaaacttcttttaacagggacgaagtaagtgacggtacctgttgaataagccacggc<br>taactacgtgccagcagccgcggtaatacgtaggtggcaagcgttatccggatttactgggtgtaaagggcgtgtaggcggga<br>ctgcaagtcagatgtgaaaactatgggctcaacccatagcctgcatttgaaactgtagttcttgagtgtcggagaggcaatcgga<br>attccgtgtgtagcggtgaaatgcgtagatatacggaggaacaccagtggcgaaggcggattgctggacgataactgacgct<br>gaggcgcgaaagcgtggggagcaaacaggattagataccctggtagtccacgccgtaaacgatggatactaggtgtggggg<br>gtctgacccccctccgtgccgcagctaacgcaataagtatcccacctggggagtacgatcgcaaggttgaaactcaaaggaatt<br>gacgggggcccgcacaagcggtggagtatgtggtttaattcgaagcaacgcgaagaaccttaccagggcttgacatcctact<br>aacgaaccagagatggattaggtgcccttcggggaaagtagagacaggtggtgcatggttgtcgtcagctcgtgtcgtgagat<br>gttgggttaagtcccgcaacgagcgcaacccttattgttagttgctacgcaagagcactctagcgagactgccgttgacaaaac<br>ggaggaaggtggggacgacgtcaaatcatcatgccccttatgtcctgggccacacacgtactacaatggcggttaacagagg<br>gaggcaaagccgcgaggcagagcaaacccctaaaagccgtcccagttcggattgcaggctgaaacccgcctgtatgaagtc<br>ggaatcgctagtaatcgcggatcagcatgccgcggtgaatacgttcccgggccttgtacacaccgcccgtcacaccatgaga<br>gtcgggaacacccgaagtccgtagcctaactgcaaagggggcgcggccgaaggtgggttcgataattggggtgaagtcgta<br>acaaggtagccgtatcggaaggtgcggctggatcacctccttt |
| *Clostridium_sp.* | SEQ ID NO: 21 | atggagagtttgatcctggctcaggatgaacgctggcggcgtgcctaatacatgcaagtcgaacgcttcacttcggtgaagagt<br>ggcgaacgggtgagtaatacataagtaacctggcatctacaggggataactgatggaaacgtcagctaagaccgcataggt<br>gtagagatcgcatgaactctatatgaaaagtgctacgggactggtagatgatggacttatggcgcattagctggttggtagggta<br>acggcctaccaaggcgacgatgcgtagccgacctgagagggtgaccggccacactgggactgagacacggcccagactc<br>ctacgggaggcagcagtagggaattttcggcaatgggggaaaccctgaccgagcaacgccgcgtgaaggaagaagtaattc<br>gttatgtaaacttctgtcatagaggaagaacggtggatatagggaatgatatccaagtgacggtactctataagaaagccacgg<br>ctaactacgtgccagcagccgcggtaatacgtaggtggcgagcgttatccggaattattgggcgtaaagagggagcaggcg<br>gcactaagggtagtggtgaaagatcgaagcttaacttcggtaagccatggaaaccgtagagctagagtgtgtgagaggatcg<br>tggaattccatgtgtagcggtgaaatgcgtagatatatggaggaacaccagtggcgaaggcgacgatctggcgcataactgac<br>gctcagtcccgaaagcgtggggagcaaataggattagataccctagtagtccacgccgtaaacgatgagtactaagtgttggg<br>tgtcaaagctcagtgctgcagttaacgcaataagtactccgcctgagtagtacgttcgcaagaatgaaactcaaaggaattgac<br>gggggcccgcacaagcggtggagcatgtggtttaattcgaagcaacgcgaagaaccttaccaggtcttgacatcgatctaaa<br>ggctccagagatggagagatagctatagagaagacaggtggtgcatggttgtcgtcagctcgtgtcgtgagatgttgggttaa<br>gtcccgcaacgagcgcaacccctgttgccagttgccagcattaagttggggactctggcgagactgccggtgacaagccgga<br>ggaaggcggggatgacgtcaaatcatcatgccccttatgacctgggctacacacgtgctacaatggacagagcagagggaa<br>gcgaagccgcgaggtggagcgaaacccataaaactgttctcagttcggactgcagtctgcaactcgactgcacgaagatgga<br>atcgctagtaatcgcgaatcagcatgtcgcggtgaatacgttctcgggccttgtacacaccgcccgtcacaccatgagagtcgg<br>taacacccgaagccggtggcctaaccgcaaggaaggagctgtctaaggtgggactgatgattggggtgaagtcgtaacaag<br>gtatccctacgggaacgtggggatggatcacctccttt |

TABLE 5-continued

| Full length 16S rDNA sequences of species (negative correlates) | | |
|---|---|---|
| Species Name | Sequence Identifier | 16S rDNA sequence |
| *Blautia_faecis* | SEQ ID NO: 22 | tattgagagtttgatcctggctcaggacgaacgctggcggcatgcctaacacatgcaagtcgagcgagttgatctcttcggagt<br>gaagctagcggcggacgggtgagtaacacgtgggcaacctgcctcatagaggggaatagcctcccgaaagggagattaata<br>ccgcataagattgtagcttcgcatgaagnagcaattaaaggagcaatccgctatgagatgggcccgcggcgcattagctagtt<br>ggtgaggtaacggctcaccaaggcgacgatgcgtagccgacctgagagggtgatcggccacattgggactgagacacggc<br>ccagactcctacgggaggcagcagtggggaatattgcacaatgggggaaaccctgatgcagcaatgccgcgtgagtgatga<br>cggccttcgggagtaaagctctgtcttcggggacgataatgacggtacccgaggaggaagccacggctaactacgtgccag<br>cagccgcggtaatacgtaggtggcaagcgttgtccggatttactgggcgtaaagggagcgtaggcggatttttaagtgagatgt<br>gaaatacccgggcttaacttgggtgctgcatttcaaactggaagtctagagtgcaggagaggagaagggaattcctagtgtag<br>cggtgaaatgcgtagagattaggaagaacaccagtggcgaaggcgcttctctggactgtaactgacgctgaggctcgaaagc<br>gtggggagcaaacaggattagataccctggtagtccacgccgtaaacgatgaatactaggtgtaggggttgtcatgacctctgt<br>gccgccgctaacgcattaagtattccgcctggggagtacggtcgcaagattaaaactcaaaggaattgacgggggcccgcac<br>aagcagcggagcatgtggtttaattcgaagcaacgcgaagaaccttacctagacttgacatctcctgcattacccttaatcgggg<br>aagtcgcttcggcgacaggaagacaggtggtgcatggttgtcgtcagctcgtgtcgtgagatgttgggttaagtcccgcaacg<br>agcgcaacccttattgttagttgctaccatttagttgagcactctagcgagactgcccgggttaaccgggaggaaggtggggat<br>gacgtcaaatcatcatgccccttatgtctagggctacacacgtgctacaatggcaagtacaaagagaagcaagaccgcgaggt<br>ggagcaaaactcaaaaacttgtctcagttcggattgtaggctgaaactcgcctacatgaagctggagttgctagtaatcgcgaat<br>cagcatgtcgcggtgaatacgttcccgggccttgtacacaccgcccgtcacaccatgagagttggcaatacccaaagtgcgtg<br>atctaactcgtaagagaggaagcgccctaaggtagggtcagcgattggggtgaagtcgtaacaaggtagccgtaggagaac<br>ctgcggctggatcacctccttt |
| *Clostridium_disporicum* | SEQ ID NO: 23 | agtgagagtttgatcctggctcaggacgaacgctggcggcgtgcctaacacatgcaagtcgagcgagtgaatctccttcggga<br>gtgaagctagcggcggacgggtgagtaacacgtgggcaacctgcctcatagaggggaatagccttccgaaaggaagattaa<br>taccgcataagattgtagcttcgcatgaagtagcaattaaaggagcaatccgctatgagatgggcccgcggcgcattagctagt<br>tggtgaggtaacggctcaccaaggcgacgatgcgtagccgacctgagagggtgatcggccacattgggactgagacacgg<br>cccagactcctacgggaggcagcagtggggaatattgcacaatgggggaaaccctgatgcagcaacgccgcgtgagtgatg<br>acggccttcgggttgtaaagctctgtcttcagggacgataatgacggtacctgaggaggaagccacggctaactacgtgccag<br>cagccgcggtaatacgtaggtggcgagcgttgtccggatttactgggcgtaaagggagcgtaggcggacttttaagtgagatg<br>tgaaatacccgggctcaacttgggtgctgcatttcaaactggaagtctagagtgcaggagaggagaatggaattcctagtgtag<br>cggtgaaatgcgtagagattaggaagaacaccagtggcgaaggcgattctctggactgtaactgacgctgaggctcgaaagc<br>gtggggagcaaacaggattagataccctggtagtccacgccgtaaacgatgaatactaggtgtaggggttgtcatgacctctgt<br>gccgccgctaacgcattaagtattccgcctggggagtacggtcgcaagattaaaactcaaaggaattgacgggggcccgcac<br>aagcauggagcatgtggtttaattcgaagcaacgcgaagaaccttacctagacttgacatctcctgcattacccttaatcgggg<br>aagttccttcgggaacaggaagacaggtggtgcatggttgtcgtcagctcgtgtcgtgagatgttgggttaagtcccgcaacga<br>gcgcaacccttattgttagttgctaccatttagttgagcactctagcgagactgcccgggttaaccgggaggaaggtggggatg<br>acgtcaaatcatcatgccccttatgtctagggctacacacgtgctacaatggcaagtacaaagagaagcaagaccgcgaggtg<br>gagcaaaactcaaaaacttgtctcagttcggattgtaggctgaaactcgcctacatgaagctggagttgctagtaatcgcgaatc<br>agcatgtcgcggtgaatacgttcccgggccttgtacacaccgcccgtcacaccatgagagttggcaatacccaaagtgcgtga<br>tctgactcgcaagagaggaagcgccctaaggtagggtcagcgattggggtgaagtcgtaacaaggtagccgtaggagaacc<br>tgcggctggatcacctccttt |
| *Anaerostipes_sp.* | SEQ ID NO: 24 | atgagagttcgatcctggctcaggataaacgctggcggcgtgcttaacacatgcaagtcgaacgaagtttttctttcgggagga<br>acttagtggcggacgggtgagtaacgcgtgggtaacctgccctgtacaggggggacaacagctggaaacggctgctaatacc<br>gcataagcccttagcactgcatggtgcatagggaaaaggagcaatccggtacaggatggacccgcgtctgattagccagttg<br>gcagggtaacggcctaccaaagcgacgatcagtagccgatctgagaggatgtacggccacattgggactgagacacggcc<br>cagactcctacgggaggcagcagtggggaatattgcacaatggaggaaactctgatgcagcgacgccgcgtgagtgaagaa<br>gtatttcggtatgtaaagctctatcagcagggaagaaaatgacggtacctgactaagaagcaccggctaaatacgtgccagca<br>gccgcggtaatacgtatggtgcaagcgttatccggatttactgggtgtaaagggagcgtaggtggcaaggcaagccagaagt |

TABLE 5-continued

Full length 16S rDNA sequences of species (negative correlates)

| Species Name | Sequence Identifier | 16S rDNA sequence |
|---|---|---|
| | | gaaaacccggggctcaaccgcgggattgcttttggaactgtcatgctagagtgcaggaggggtgagcggaattcctagtgtag<br>cggtgaaatgcgtagatattaggaggaacaccggaggcgaaggcggctcactggactgtaactgacactgaggctcgaaag<br>cgtggggagcaaacaggattagataccctggtagtccacgcggtaaacgatgaatactagatgtcgggtagcaaagctactc<br>ggtgtcgtcgcaaacgcaataagtattccacctggggagtacgttcgcaagaatgaaactcaaaggaattgacggggacccg<br>cacaagcggtggagcatgtggtttaattcgaagcaacgcgaagaaccttacctgctcttgacatcccattcgatagagggtaat<br>gcctctagcccttcgggggaatggagacaggtggtgcatggttgtcgtcagctcgtgtcgtgagatgttgggttaagtcccgca<br>acgagcgcaacccttattgtcagtagccagcaggtgaagctgggcactctgatgagactgccggggataacccggaggaag<br>gtggggatgacgtcaaatcatcatgccccttatgagcagggctacacacgtgctacaatggcgtaaacagagggaagcgaag<br>gagtgatccggagcaaatctcaaaaataacgtctcagttcggattgtagtctgcaactcgactacatgaagctggaatcgctagt<br>aatcgcagatcagaatgctgcggtgaatacgttcccgggtcttgtacacaccgcccgtcacaccatgggagtcggtaatgccc<br>gaagtcagtgactcaaccgaaaggagagagctgccgaaggcaggactggtaactggggtgaagtcgtaacaaggtagccg<br>tatcggaaggtgcggctggatcacctccttt |
| *Ruminococcus_bicirculans* | SEQ ID NO: 25 | tttagagagtttgatcctggctcaggacgaacgctggcggcgtgcctaacacatgcaagtcgaacggagcttgaggggcttgc<br>ccttcaagcttagtggcggacgggtgagtaacgcgtgagtaacctgcctctcagaggggataacgttctgaaaaggacgcta<br>ataccgcatgacatcccggggccgcatggccctgggatcaaaggagcaatccgctgagagatggactcgcgtccgattagct<br>agttggtgagataaaggcccaccaaggcgacgatcggtagccggactgagaggttgaacggccacattgggactgagacac<br>ggcccagactcctacgggaggcagcagtgggggatattgcacaatggagggaactctgatgcagcaacgccgcgtgaggg<br>aagaaggtcttcggattgtaaacctttgtcctcagggaagataatgacggtacctgaggaggaagctccggctaactacgtgcc<br>agcagccgcggtaatacgtagggagcaagcgttgtccggatttactgggtgtaaagggtgcgtaggcggaactgcaagtcag<br>tggtgaaatctgagggctcaaccctcaaactgccattgaaactgtggttcttgagtgaagtagaggtaggcggaattcccggtgt<br>agcggtggaatgcgtagagatcgggaggaacaccagtggcgaaggcggcctactgggctttaactgacgctgaggcacga<br>aagcatgggtagcaaacaggattagataccctggtagtccatgccgtaaacgatgattactaggtgtgggggggtctgaccccct<br>ccgtgccggagttaacacaataagtaatccacctggggagtacggccgcaaggttgaaactcaaaggaattgacgggggcc<br>cgcacaagcagtggagtatgtggtttaattcgacgcaacgcgaagaaccttaccaggtcttgacatccaactaacgaggtaga<br>gatacgtcaggtgcccttcggggaaagttgagacaggtggtgcatggttgtcgtcagctcgtgtcgtgagatgttgggttaagtc<br>ccgcaacgagcgcaacccttgtgattagttgctacgcaagagcactctaatcagactgccgttgacaaaacggaggaaggtg<br>gggatgacgtcaaatcatcatgccctttatgacctgggctacacacgtactacaatggccgtaaacagagagaggcgacaccg<br>cgaggtgaagcgaaaccctaaaaacggtctcagttcggattgtaggctgcaacccgcctacatgaagttggaattgctagtaat<br>cgcggatcagcatgccgcggtgaatacgttcccgggccttgtacacaccgcccgtcacaccatgggagccggtaatacccga<br>agtcagtagtctaaccgcaagggggcgctgccgaaggtaggattggcgactggggtgaagtcgtaacaaggtagccgtat<br>cggaaggtgcggctggatcacctccttt |
| *Ruminococcus_bicirculans* | SEQ ID NO: 26 | attaagagtttgatcctggctcaggacgaacgctggcggcacgcttaacacatgcaagtcgaacgagagaagagaagcttgct<br>tttctgatctagtggcggacgggtgagtaacacgtgagcaatctgcctttcagaggggataccgattggaaacgatcgttaata<br>ccgcataacataattgaaccgcatgatttgattatcaaagatttatcgctgaaagatgagctcgcgtctgattagctagttggtaag<br>gtaacggcttaccaaggcgacgatcagtagccggactgagaggttgatcggccacattgggactgagacacggcccagact<br>cctacgggaggcagcagtggggaatattgcacaatggaggaaactctgatgcagcgatgccgcgtgagggaagaaggtttt<br>aggattgtaaacctctgtcttcagggacgaaaaaaaagacggtacctgaggaggaagctccggctaactacgtgccagcagc<br>cgcggtaatacgtagggagcgagcgttgtccggaattactgggtgtaaagggagcgtaggcgggatcgcaagtcagatgtg<br>aaaactatgggcttaacccataaactgcatttgaaactgtggttcttgagtgaagtagaggtaagcggaattcctagtgtagcggt<br>gaaatgcgtagatattaggaggaacatcagtggcgaaggcggcttactgggctttaactgacgctgaggctcgaaagcgtgg<br>ggagcaaacaggattagataccctggtagtccacgccgtaaacgatgattactaggtgtggggggactgacccccttccgtgcc<br>gcagcaaacgcaataagtaatccacctggggagtacgaccgcaaggttgaaactcaaaggaattgacgggggcccgcacaa<br>gcagtggagtatgtggattaattcgaagcaacgcgaagaaccttaccaggtcttgacatcgtatgcatagctcagagatgagtg<br>aaatctcttcggagacatatagacaggtggtgcatggttgtcgtcagctcgtgtcgtgagatgttgggttaagtcccgcaacgag<br>cgcaacccttactgttagttgctacgcaagagcactctagcaggactgccgttgacaaaacggaggaaggtggggatgacgt<br>caaatcatcatgccccttatgacctgggcctcacacgtactacaatggctgtcaacagagggatgcaaagccgcgaggtggag |

TABLE 5-continued

| Full length 16S rDNA sequences of species (negative correlates) | | |
|---|---|---|
| Species Name | Sequence Identifier | 16S rDNA sequence |
| | | cgaacccctaaaagcagtcttagttcggattgtaggctgcaacccgcctacatgaagtcggaattgctagtaatcgcagatcag |
| | | catgctgcggtgaatacgttcccgggccttgtacacaccgcccgtcacgccatgggagtcggtaacacccgaagcctgtagtc |
| | | taaccgcaaggaggacgcagtcgaaggtgggattgatgactggggtgaagtcgtaacaaggtagccgtatcggaaggtgcg |
| | | gctggatcacctcctt |
| *Streptococc* | SEQ ID | aatgagagtttgatcctggctcaggacgaacgctggcggcgtgcctaatacatgcaagtagaacgcacagtttataccgtagct |
| *us_gordonii* | NO: 27 | tgctacaccatagactgtgagttgcgaacgggtgagtaacgcgtaggtaacctgcctggtagcgggggataactattggaaac |
| | | gatagctaataccgcataatattaattattgcatgataattgattgaaagatgcaactgcatcactaccagatggacctgcgttgtat |
| | | tagctagtaggtgaggtaacggctcacctaggcgacgatacatagccgacctgagagggtgatcggccacactgggactga |
| | | gacacggcccagactcctacgggaggcagcagtagggaatcttcggcaatggacgaaagtctgaccgagcaacgccgcgt |
| | | gagtgaagaaggttttcggatcgtaaagctctgttgtaagagaagaacgggtgtgagagtggaaagttcacactgtgacggtat |
| | | cttaccagaaagggacggctaactacgtgccagcagccgcggtaatacgtaggtcccgagcgttgtccggatttattgggcgt |
| | | aaagcgagcgcaggcggttagataagtctgaagttaaaggctgtggcttaaccatagtacgctttggaaactgtttaacttgagt |
| | | gcagaaggggagagtggaattccatgtgtagcggtgaaatgcgtagatatatggaggaacaccggtggcgaaagcggctct |
| | | ctggtctgtaactgacgctgaggctcgaaagcgtggggagcgaacaggattagataccctggtagtccacgccgtaaacgat |
| | | gagtgctaggtgttaggccctttccggggcttagtgccgcagctaacgcattaagcactccgcctggggagtacgaccgcaag |
| | | gttgaaactcaaaggaattgacgggggcccgcacaagcggtggagcatgtggtttaattcgaagcaacgcgaagaaccttac |
| | | caggtcttgacatcccgatgcccgctctagagatagagttttacttcggtacatcggtgacaggtggtgcatggttgtcgtcagct |
| | | cgtgtcgtgagatgttgggttaagtcccgcaacgagcgcaacccatattgttagttgccatcattcagttgggcactctagcgaga |
| | | ctgccggtaataaaccggaggaaggtggggatgacgtcaaatcatcatgccccttatgacctgggctacacacgtgctacaat |
| | | ggctggtacaacgagtcgcaagtcggtgacggcaagctaatctcttaaagccagtctcagttcggattgtaggctgcaactcgc |
| | | ctacatgaagtcggaatcgctagtaatcgcggatcagcacgccgcggtgaatacgttcccgggccttgtacacaccgcccgtc |
| | | acaccacgagagtttgtaacacccgaagtcggtgaggtaaccttttaggagccagccgcctaaggtgggatagatgattgggg |
| | | tgaagtcgtaacaaggtagccgtatcggaaggtgcggctggatcacctcctt |
| *Streptococc* | SEQ ID | aatgagagtttgatcctggctcaggacgaacgctggcggcgtgcctaatacatgcaagtagaacgcacagtttataccgtagct |
| *us_gordonii* | NO: 28 | tgctacaccatagactgtgagttgcgaacgggtgagtaacgcgtaggtaacctgcctggtagcgggggataactattggaaac |
| | | gatagctaataccgcataatattaattattgcatgataattgattgaaagatgcaactgcatcactaccagatggacctgcgttgtat |
| | | tagctagtaggtgaggtaacggctcacctaggcgacgatacatagccgacctgagagggtgatcggccacactgggactga |
| | | gacacggcccagactcctacgggaggcagcagtagggaatcttcggcaatggacgaaagtctgaccgagcaacgccgcgt |
| | | gagtgaagaaggttttcggatcgtaaagctctgttgtaagagaagaacgggtgtgagagtggaaagttcacactgtgacggtat |
| | | cttaccagaaagggacggctaactacgtgccagcagccgcggtaatacgtaggtcccgagcgttgtccggatttattgggcgt |
| | | aaagcgagcgcaggcggttagataagtctgaagttaaaggctgtggcttaaccatagtacgctttggaaactgtttaacttgagt |
| | | gcagaaggggagagtggaattccatgtgtagcggtgaaatgcgtagatatatggaggaacaccggtggcgaaagcggctct |
| | | ctggtctgtaactgacgctgaggctcgaaagcgtggggagcgaacaggattagataccctggtagtccacgccgtaaacgat |
| | | gagtgctaggtgttaggccctttccggggcttagtgccgcagctaacgcattaagcactccgcctggggagtacgaccgcaag |
| | | gttgaaactcaaaggaattgacgggggcccgcacaagcggtggagcatgtggtttaattcgaagcaacgcgaagaaccttac |
| | | caggtcttgacatcccgatgcccgctctagagatagagttttacttcggtacatcggtgacaggtggtgcatggttgtcgtcagct |
| | | cgtgtcgtgagatgttgggttaagtcccgcaacgagcgcaacccttattgttagttgccatcattcagttgggcactctagcgaga |
| | | ctgccggtaataaaccggaggaaggtggggatgacgtcaaatcatcatgccccttatgacctgggctacacacgtgctacaat |
| | | ggctggtacaacgagtcgcaagtcggtgacggcaagctaatctcttaaagccagtctcagttcggattgtaggctgcaactcgc |
| | | ctacatgaagtcggaatcgctagtaatcgcggatcagcacgccgcggtgaatacgttcccgggccttgtacacaccgcccgtc |
| | | acaccacgagagtttgtaacacccgaagtcggtgaggtaaccttttaggagccagccgcctaaggtgggatagatgattgggg |
| | | tgaagtcgtaacaaggtagccgtatcggaaggtgcggctggatcacctcctt |
| *Streptococc* | SEQ ID | aatgagagtttgatcctggctcaggacgaacgctggcggcgtgcctaatacatgcaagtagaacgcacagtttataccgtagct |
| *us_gordonii* | NO: 29 | tgctacaccatagactgtgagttgcgaacgggtgagtaacgcgtaggtaacctgcctggtagcgggggataactattggaaac |
| | | gatagctaataccgcataatattaattattgcatgataattgattgaaagatgcaactgcatcactaccagatggacctgcgttgtat |

TABLE 5-continued

Full length 16S rDNA sequences of species (negative correlates)

| Species Name | Sequence Identifier | 16S rDNA sequence |
| --- | --- | --- |
| | | tagctagtaggtgaggtaacggctcacctaggcgacgatacatagccgacctgagagggtgatcggccacactgggactga<br>gacacggcccagactcctacgggaggcagcagtagggaatcttcggcaatggacgaaagtctgaccgagcaacgccgcgt<br>gagtgaagaaggttttcggatcgtaaagctctgttgtaagagaagaacgggtgtgagagtggaaagttcacactgtgacggtat<br>cttaccagaaagggacggctaactacgtgccagcagccgcggtaatacgtaggtcccgagcgttgtccggatttattgggcgt<br>aaagcgagcgcaggcggttagataagtctgaagttaaaggctgtggcttaaccatagtacgctttggaaactgtttaacttgagt<br>gcagaaggggagagtggaattccatgtgtagcggtgaaatgcgtagatatatggaggaacaccggtggcgaaagcggctct<br>ctggtctgtaactgacgctgaggctcgaaagcgtggggagcgaacaggattagataccctggtagtccacgccgtaaacgat<br>gagtgctaggtgttaggccctttccggggcttagtgccgcagctaacgcattaagcactccgcctggggagtacgaccgcaag<br>gttgaaactcaaaggaattgacgggggcccgcacaagcggtggagcatgtggtttaattcgaagcaacgcgaagaaccttac<br>caggtcttgacatcccgatgcccgctctagagatagagttttacttcggtacatcggtgacaggtggtgcatggttgtcgtcagct<br>cgtgtcgtgagatgttgggttaagtcccgcaacgagcgcaacccttattgttagttgccatcattcagttgggcactctagcgaga<br>ctgccggtaataaaccggaggaaggtggggatgacgtcaaatcatcatgccccttatgacctgggctacacacgtgctacaat<br>ggctggtacaacgagtcgcaagtcggtgacggcaagctaatctcttaaagccagtctcagttcggattgtaggctgcaactcgc<br>ctacatgaagtcggaatcgctagtaatcgcggatcagcacgccgcggtgaatacgttcccgggccttgtacacaccgcccgtc<br>acaccacgagagtttgtaacacccgaagtcggtgaggtaaccttttaggagccagccgcctaaggtgggatagatgattgggg<br>tgaagtcgtaacaaggtagccgtatcggaaggtgcggctggatcacctcctt |
| *Streptococcus_gordonii* | SEQ ID NO: 30 | aatgagagtttgatcctggctcaggacgaacgctggcggcgtgcctaatacatgcaagtagaacgcacagtttataccgtagct<br>tgctacaccataaactgtgagttgcgaacgggtgagtaacgcgtaggtaacctgcctggtagcgggggataactattggaaac<br>gatagctaataccgcataatattgattattgcatgataattgattgaaagatgctattgcatcactaccagatggacctgcgttgtatt<br>agctagtaggtgaggtaacggctcacctaggcgacgatacatagccgacctgagagggtgatcggccacactgggactgag<br>acacggcccagactcctacgggaggcagcagtagggaatcttcggcaatggacgaaagtctgaccgagcaacgccgcgtg<br>agtgaagaaggttttcggatcgtaaagctctgttgtaagagaagaacgggtgtgagagtggaaagttcacactgtgacggtatc<br>ttaccagaaagggacggctaactacgtgccagcagccgcggtaatacgtaggtcccgagcgttgtccggatttattgggcgta<br>aagcgagcgcaggcggttagataagtctgaagttaaaggctgtggcttaaccatagtacgctttggaaactgtttaacttgagtg<br>cagaaggggagagtggaattccatgtgtagcggtgaaatgcgtagatatatggaggaacaccggtggcgaaagcggctctct<br>ggtctgtaactgacgctgaggctcgaaagcgtggggagcgaacaggattagataccctggtagtccacgccgtaaacgatga<br>gtgctaggtgttaggccctttccggggcttagtgccgcagctaacgcattaagcactccgcctggggagtacgaccgcaaggt<br>tgaaactcaaaggaattgacgggggcccgcacaagcggtggagcatgtggtttaattcgaagcaacgcgaagaaccttacca<br>ggtcttgacatcccgatgcccgctctagagatagagttttacttcggtacatcggtgacaggtggtgcatggttgtcgtcagctcg<br>tgtcgtgagatgttgggttaagtcccgcaacgagcgcaacccttattgttagttgccatcattcagttgggcactctagcgagact<br>gccggtaataaaccggaggaaggtggggatgacgtcaaatcatcatgccccttatgacctgggctacacacgtgctacaatgg<br>ctggtacaacgagtcgcaagtcggtgacggcaagctaatctcttaaagccagtctcagttcggattgtaggctgcaactcgcct<br>acatgaagtcggaatcgctagtaatcgcggatcagcacgccgcggtgaatacgttcccgggccttgtacacaccgcccgtcac<br>accacgagagtttgtaacacccgaagtcggtgaggtaaccttttaggagccagccgcctaaggtgggatagatgattggggtg<br>aagtcgtaacaaggtagccgtatcggaaggtgcggctggatcacctcctt |
| *Akkermansia_muciniphila* | SEQ ID NO: 31 | atggagagtttgattctggctcagaacgaacgctggcggcgtggataagacatgcaagtcgaacgagagaattgctagcttgc<br>taataattctctagtggcgcacgggtgagtaacacgtgagtaacctgcccccgagagcgggatagccctgggaaactgggatt<br>aataccgcatagtatcgaaagattaaagcagcaatgcgcttggggatgggctcgcggcctattagttagttggtgaggtaacgg<br>ctcaccaaggcgatgacgggtagccggtctgagaggatgtccggccacactggaactgagacacggtccagacacctacg<br>ggtggcagcagtcgagaatcattcacaatgggggaaaccctgatggtgcgacgccgcgtgggggaatgaaggtcttcggatt<br>gtaaacccctgtcatgtgggagcaaattaaaaagatagtaccacaagaggaagagacggctaactctgtgccagcagccgcg<br>gtaatacagaggtctcaagcgttgttcggaatcactgggcgtaaagcgtgcgtaggctgtttcgtaagtcgtgtgtgaaaggcg<br>cgggctcaacccgcggacggcacatgatactgcgagactagagtaatggaggggggaaccggaattctcggtgtagcagtga<br>aatgcgtagatatcgagaggaacactcgtggcgaaggcgggttcctggacattaactgacgctgaggcacgaaggccaggg<br>gagcgaaagggattagataccccctgtagtcctggcagtaaacggtgcacgcttggtgtgcggggaatcgaccccctgcgtgc<br>cggagctaacgcgttaagcgtgccgcctggggagtacggtcgcaagattaaaactcaaagaaattgacggggacccgcaca |

TABLE 5-continued

| Full length 16S rDNA sequences of species (negative correlates) | | |
|---|---|---|
| Species Name | Sequence Identifier | 16S rDNA sequence |
| | | agcggtggagtatgtggcttaattcgatgcaacgcgaagaaccttacctgggcttgacatgtaatgaacaacatgtgaaagcat<br>gcgactcttcggaggcgttacacaggtgctgcatggccgtcgtcagctcgtgtcgtgagatgtttggttaagtccagcaacgag<br>cgcaacccctgttgccagttaccagcacgtgaaggtggggactctggcgagactgcccagatcaactgggaggaaggtggg<br>gacgacgtcaggtcagtatggcccttatgcccagggctgcacacgtactacaatgcccagtacagagggggccgaagccgc<br>gaggcggaggaaatcctaaaaactgggcccagttcggactgtaggctgcaacccgcctacacgaagccggaatcgctagta<br>atggcgcatcagctacggcgccgtgaatacgttcccgggtcttgtacacaccgcccgtcacatcatggaagccggtcgcaccc<br>gaagtatctgaagccaaccgcaaggaggcagggtcctaaggtgagactggtaactgggatgaagtcgtaacaaggtagccg<br>taggggaacctgcggctggatcacctccttt |
| *Akkermansi a_muciniphi la* | SEQ ID NO: 32 | atggagagtttgattctggctcagaacgaacgctggcggcgtggataagacatgcaagtcgaacgagagaattgctagcttgc<br>taataattctctagtggcgcacgggtgagtaacacgtgagtaacctgcccccgagagcgggatagccctgggaaactgggatt<br>aataccgcatagtatcgaaagattaaagcagcaatgcgcttggggatgggctcgcggcctattagttagttggtgaggtaacgg<br>ctcaccaaggcgatgacgggtagccggtctgagaggatgtccggccacactggaactgagacacggtccagacacctacg<br>ggtggcagcagtcgagaatcattcacaatgggggaaaccctgatggtgcgacgccgcgtgggggaatgaaggtcttcggatt<br>gtaaacccctgtcatgtgggagcaaattaaaaagatagtaccacaagaggaagagacggctaactctgtgccagcagccgcg<br>gtaatacagaggtctcaagcgttgttcggaatcactgggcgtaaagcgtgcgtaggctgtttcgtaagtcgtgtgtgaaaggcg<br>cgggctcaacccgcggacggcacatgatactgcgagactagagtaatggaggggggaaccggaattctcggtgtagcagtga<br>aatgcgtagatatcgagaggaacactcgtggcgaaggcgggttcctggacattaactgacgctgaggcacgaaggccaggg<br>gagcgaaagggattagataccccctgtagtcctggcagtaaacggtgcacgcttggtgtgcggggaatcgacccccctgcgtgc<br>cggagctaacgcgttaagcgtgccgcctggggagtacggtcgcaagattaaaactcaaagaaattgacggggacccgcaca<br>agcggtggagtatgtggcttaattcgatgcaacgcgaagaaccttacctgggcttgacatgtaatgaacaacatgtgaaagcat<br>gcgactcttcggaggcgttacacaggtgctgcatggccgtcgtcagctcgtgtcgtgagatgtttggttaagtccagcaacgag<br>cgcaacccctgttgccagttaccagcacgtgaaggtggggactctggcgagactgcccagatcaactgggaggaaggtggg<br>gacgacgtcaggtcagtatggcccttatgcccagggctgcacacgtactacaatgcccagtacagagggggccgaagccgc<br>gaggcggaggaaatcctaaaaactgggcccagttcggactgtaggctgcaacccgcctacacgaagccggaatcgctagta<br>atggcgcatcagctacggcgccgtgaatacgttcccgggtcttgtacacaccgcccgtcacatcatggaagccggtcgcaccc<br>gaagtatctgaagccaaccgcaaggaggcagggtcctaaggtgagactggtaactgggatgaagtcgtaacaaggtagccg<br>taggggaacctgcggctggatcacctccttt |
| *Akkermansi a muciniphi la* | SEQ ID NO: 33 | atggagagtttgattctggctcagaacgaacgctggcggcgtggataagacatgcaagtcgaacgagagaattgctagcttgc<br>taataattctctagtggcgcacgggtgagtaacacgtgagtaacctgcccccgagagcgggatagccctgggaaactgggatt<br>aataccgcatagtatcgaaagattaaagcagcaatgcgcttggggatgggctcgcggcctattagttagttggtgaggtaacgg<br>ctcaccaaggcgatgacgggtagccggtctgagaggatgtccggccacactggaactgagacacggtccagacacctacg<br>ggtggcagcagtcgagaatcattcacaatgggggaaaccctgatggtgcgacgccgcgtgggggaatgaaggtcttcggatt<br>gtaaacccctgtcatgtgggagcaaattaaaaagatagtaccacaagaggaagagacggctaactctgtgccagcagccgcg<br>gtaatacagaggtctcaagcgttgttcggaatcactgggcgtaaagcgtgcgtaggctgtttcgtaagtcgtgtgtgaaaggcg<br>cgggctcaacccgcggacggcacatgatactgcgagactagagtaatggaggggggaaccggaattctcggtgtagcagtga<br>aatgcgtagatatcgagaggaacactcgtggcgaaggcgggttcctggacattaactgacgctgaggcacgaaggccaggg<br>gagcgaaagggattagataccccctgtagtcctggcagtaaacggtgcacgcttggtgtgcggggaatcgacccccctgcgtgc<br>cggagctaacgcgttaagcgtgccgcctggggagtacggtcgcaagattaaaactcaaagaaattgacggggacccgcaca<br>agcggtggagtatgtggcttaattcgatgcaacgcgaagaaccttacctgggcttgacatgtaatgaacaacatgtgaaagcat<br>gcgactcttcggaggcgttacacaggtgctgcatggccgtcgtcagctcgtgtcgtgagatgtttggttaagtccagcaacgag<br>cgcaacccctgttgccagttaccagcacgtgaaggtggggactctggcgagactgcccagatcaactgggaggaaggtggg<br>gacgacgtcaggtcagtatggcccttatgcccagggctgcacacgtactacaatgcccagtacagagggggccgaagccgc<br>gaggcggaggaaatcctaaaaactgggcccagttcggactgtaggctgcaacccgcctacacgaagccggaatcgctagta<br>atggcgcatcagctacggcgccgtgaatacgttcccgggtcttgtacacaccgcccgtcacatcatggaagccggtcgcaccc<br>gaagtatctgaagccaaccgcaaggaggcagggtcctaaggtgagactggtaactgggatgaagtcgtaacaaggtagccg<br>taggggaacctgcggctggatcacctccttt |

TABLE 5-continued

Full length 16S rDNA sequences of species (negative correlates)

| Species Name | Sequence Identifier | 16S rDNA sequence |
| --- | --- | --- |
| *Eubacterium _rectale* | SEQ ID NO: 34 | atgagagtttgatcctggctcaggatgaacgctggcggcgtgcttaacacatgcaagtcgaacgaagcactttatttgatttcctt<br>cgggactgattattttgtgactgagtggcggacgggtgagtaacgcgtgggtaacctgccagtacaggggggataacagagg<br>aaacggctgctaataccgcataagcgcacggcatcgcatgatgcagtgtgaaaaactccggtggtataagatggacccgcgtt<br>ggattagctagttggtgaggtaacggcccaccaaggcgacgatccatagccgacctgagagggtgaccggccacattggga<br>ctgagacacggcccaaactcctacgggaggcagcagtggggaatattgcacaatgggcgaaagcctgatgcagcgacgcc<br>gcgtgagcgaagaagtatttcggtatgtaaagctctatcagcagggaagataatgacggtacctgactaagaagcaccggcta<br>aatacgtgccagcagccgcggtaatacgtatggtgcaagcgttatccggatttactgggtgtaaagggagcgcaggcggtgc<br>ggcaagtctgatgtgaaagcccggggctcaaccccggtactgcattggaaactgtcgtactagagtgtcggaggggtaagcg<br>gaattcctagtgtagcggtgaaatgcgtagatattaggaggaacaccagtggcgaaggcggcttactggacgataactgacgc<br>tgaggctcgaaagcgtggggagcaaacaggattagataccctggtagtccacgccgtaaacgatgaatactaggtgttggga<br>agcattgcttctcggtgccgtcgcaaacgcagtaagtattccacctggggagtacgttcgcaagaatgaaactcaaaggaattg<br>acggggacccgcacaagcggtggagcatgtggtttaattcgaagcaacgcgaagaaccttaccaagtcttgacatccttctga<br>ccggtacttaaccgtaccttctcttcggagcaggagtgacaggtggtgcatggttgtcgtcagctcgtgtcgtgagatgttgggtt<br>aagtcccgcaacgagcgcaacccttatctttagtagccagcggttcggccgggcactctagagagactgccagggataacct<br>ggaggaaggcggggatgacgtcaaatcatcatgccccttatgacttgggctacacacgtgctacaatggcgtaaacaaaggg<br>aagcaaagctgtgaagccgagcaaatctcaaaaataacgtctcagttcggactgtagtctgcaacccgactacacgaagctgg<br>aatcgctagtaatcgcagatcagaatgctgcggtgaatacgttcccgggtcttgtacacaccgcccgtcacaccatgggagttg<br>ggaatgcccgaagccagtgacctaaccgaaaggaaggagctgtcgaaggcaggctcgataactggggtgaagtcgtaaca<br>aggtagccgtatcggaaggtgcggctggatcacctccttt |
| *Eubacterium _rectale* | SEQ ID NO: 35 | atgagagtttgatcctggctcaggatgaacgctggcggcgtgcttaacacatgcaagtcgaacgaagcactttatttgatttcctt<br>cgggactgattattttgtgactgagtggcggacgggtgagtaacgcgtgggtaacctgccttgtacaggggggataacagttgg<br>aaacggctgctaataccgcataagcgcacagcatcgcatgatgcagtgtgaaaaactccggtggtataagatggacccgcgtt<br>ggattagctagttggtgaggtaacggcccaccaaggcgacgatccatagccgacctgagagggtgaccggccacattggga<br>ctgagacacggcccaaactcctacgggaggcagcagtggggaatattgcacaatgggcgaaagcctgatgcagcgacgcc<br>gcgtgagcgaagaagtatttcggtatgtaaagctctatcagcagggaagataatgacggtacctgactaagaagcaccggcta<br>aatacgtgccagcagccgcggtaatacgtatggtgcaagcgttatccggatttactgggtgtaaagggagcgcaggcggtgc<br>ggcaagtctgatgtgaaagcccggggctcaaccccggtactgcattggaaactgtcgtactagagtgtcggaggggtaagcg<br>gaattcctagtgtagcggtgaaatgcgtagatattaggaggaacaccagtggcgaaggcggcttactggacgataactgacgc<br>tgaggctcgaaagcgtggggagcaaacaggattagataccctggtagtccacgccgtaaacgatgaatactaggtgttggga<br>agcattgatctcggtgccgtcgcaaacgcagtaagtattccacctggggagtacgttcgcaagaatgaaactcaaaggaattg<br>acggggacccgcacaagcggtggagcatgtggtttaattcgaagcaacgcgaagaaccttaccaagtcttgacatccttctga<br>ccggtacttaaccgtaccttctcttcggagcaggagtgacaggtggtgcatggttgtcgtcagctcgtgtcgtgagatgttgggtt<br>aagtcccgcaacgagcgcaacccttatctttagtagccagcggtccggccgggcactctagagagactgccagggataacct<br>ggaggaaggcggggatgacgtcaaatcatcatgccccttatgacttgggctacacacgtgctacaatggcgtaaacaaaggg<br>aagcaaagctgtgaagccgagcaaatctcaaaaataacgtctcagttcggactgtagtctgcaacccgactacacgaagagg<br>aatcgctagtaatcgcagatcagaatgctgcggtgaatacgttcccgggtcttgtacacaccgcccgtcacaccatgggagttg<br>ggaatgcccgaagccagtgacctaaccgaaaggaaggagctgtcgaaggcaggctcgataactggggtgaagtcgtaaca<br>aggtagccgtatcggaaggtgcggctggatcacctccttt |
| *Eubacterium _rectale* | SEQ ID NO: 36 | atgagagtttgatcctggctcaggatgaacgctggcggcgtgcttaacacatgcaagtcgaacgaagcactttatttgatttcctt<br>cgggactgattattttgtgactgagtggcggacgggtgagtaacgcgtgggtaacctgccttgtacaggggggataacagttgg<br>aaacggctgctaataccgcataagcgcacggcatcgcatgatgcagtgtgaaaaactccggtggtataagatggacccgcgtt<br>ggattagctagttggtgaggtaacggcccaccaaggcgacgatccatagccgacctgagagggtgaccggccacattggga<br>ctgagacacggcccaaactcctacgggaggcagcagtggggaatattgcacaatgggcgaaagcctgatgcagcgacgcc<br>gcgtgagcgaagaagtatttcggtatgtaaagctctatcagcagggaagataatgacggtacctgactaagaagcaccggcta<br>aatacgtgccagcagccgcggtaatacgtatggtgcaagcgttatccggatttactgggtgtaaagggagcgcaggcggtgc |

TABLE 5-continued

Full length 16S rDNA sequences of species (negative correlates)

| Species Name | Sequence Identifier | 16S rDNA sequence |
|---|---|---|
| | | ggcaagtctgatgtgaaagcccggggctcaaccccggtactgcattggaaactgtcgtactagagtgtcggaggggtaagcg<br>gaattcctagtgtagcggtgaaatgcgtagatattaggaggaacaccagtggcgaaggcggcttactggacgataactgacgc<br>tgaggctcgaaagcgtggggagcaaacaggattagataccctggtagtccgcgccgtaaacgatgaatactaggtgttggga<br>agcattgcttctcggtgccgtcgcaaacgcagtaagtattccacctggggagtacgttcgcaagaatgaaactcaaaggaattg<br>acggggacccgcacaagcggtggagcatgtggtttaattcgaagcaacgcgaagaaccttaccaagtcttgacatccttctga<br>ccggtacttaaccgtaccttctcttcggagcaggagtgacaggtggtgcatggttgtcgtcagctcgtgtcgtgagatgttgggtt<br>aagtcccgcaacgagcgcaacccttatctttagtagccagcggtttggccgggcactctagagagactgccagggataacctg<br>gaggaaggcggggatgacgtcaaatcatcatgccccttatgacttgggctacacacgtgctacaatggcgtaaacaaaggga<br>agcaaagctgtgaagccgagcaaatctcaaaaataacgtctcagttcggactgtagtctgcaacccgactacacgaagctgga<br>atcgctagtaatcgcagatcagaatgctgcggtgaatacgttcccgggtcttgtacacaccgcccgtcacaccatgggagttgg<br>gaatgcccgaagccagtgacctaaccgaaaggaaggagctgtcgaaggcaggctcgataactggggtgaagtcgtaacaa<br>ggtagccgtatcggaaggtgcggctggatcacctccttt |
| *Eubacterium _rectale* | SEQ ID NO: 37 | atgagagtttgatcctggctcaggatgaacgctggcggcgtgcttaacacatgcaagtcgaacgaagcactttatttgatttcctt<br>cgggactgattattttgtgactgagtggcggacgggtgagtaacgcgtgggtaacctgccttgtacaggggggataacagttgg<br>aaacggctgctaataccgcataagcgcacggcatcgcatgatgcagtgtgaaaaactccggtggtataagatggacccgcgtt<br>ggattagctagttggtgaggtaacggcccaccaaggcgacgatccatagccgacctgagagggtgaccggccacattggga<br>ctgagacacggcccaaactcctacgggaggcagcagtggggaatattgcacaatgggcgaaagcctgatgcagcgacgcc<br>gcgtgagcgaagaagtatttcggtatgtaaagctctatcagcagggaagataatgacggtacctgactaagaagcaccggcta<br>aatacgtgccagcagccgcggtaatacgtatggtgcaagcgttatccggatttactgggtgtaaagggagcgcaggcggtgc<br>ggcaagtctgatgtgaaagcccggggctcaaccccggtactgcattggaaactgtcgtactagagtgtcggaggggtaagcg<br>gaattcctagtgtagcggtgaaatgcgtagatattaggaggaacaccagtggcgaaggcggcttactggacgataactgacgc<br>tgaggctcgaaagcgtggggagcaaacaggattagataccctggtagtccacgccgtaaacgatgaatactaggtgttggga<br>agcattgcttctcggtgccgtcgcaaacgcagtaagtattccacctggggagtacgttcgcaagaatgaaactcaaaggaattg<br>acggggacccgcacaagcggtggagcatgtggtttaattcgaagcaacgcgaagaaccttaccaagtcttgacatccttctga<br>ccggtacttaaccgtaccttctcttcggagcaggagtgacaggtggtgcatggttgtcgtcagctcgtgtcgtgagatgttgggtt<br>aagtcccgcaacgagcgcaacccttatctttagtagccagcggttcggccgggcactctagagagactgccagggataacct<br>ggaggaaggcggggatgacgtcaaatcatcatgccccttatgacttgggctacacacgtgctacaatggcgtaaacaaaggg<br>aagcaaagctgtgaagccgagcaaatctcaaaaataacgtctcagttcggactgtagtctgcaacccgactacacgaagctgg<br>aatcgctagtaatcgcagatcagaatgctgcggtgaatacgttcccgggtcttgtacacaccgcccgtcacaccatgggagttg<br>ggaatgcccgaagccagtgacctaaccgaaaggaaggagctgtcgaaggcaggctcgataactggggtgaagtcgtaaca<br>aggtagccgtatcggaaggtgcggctggatcacctccttt |
| *Eubacterium _rectale* | SEQ ID NO: 38 | atgagagtttgatcctggctcaggatgaacgctggcggcgtgcttaacacatgcaagtcgaacgaagcactttatttgatttcctt<br>cgggactgattattttgtgactgagtggcggacgggtgagtaacgcgtgggtaacctgccttgtacaggggggataacagttgg<br>aaacggctgctaataccgcataagcgcacagcatcgcatgatgcagtgtgaaaaactccggtggtataagatggacccgcgtt<br>ggattagctagttggtgaggtaacggcccaccaaggcgacgatccatagccgacctgagagggtgaccggccacattggga<br>ctgagacacggcccaaactcctacgggaggcagcagtggggaatattgcacaatgggcgaaagcctgatgcagcgacgcc<br>gcgtgagcgaagaagtatttcggtatgtaaagctctatcagcagggaagataatgacggtacctgactaagaagcaccggcta<br>aatacgtgccagcagccgcggtaatacgtatggtgcaagcgttatccggatttactgggtgtaaagggagcgcaggcggtgc<br>ggcaagtctgatgtgaaagcccggggctcaaccccggtactgcattggaaactgtcgtactagagtgtcggaggggtaagcg<br>gaattcctagtgtagcggtgaaatgcgtagatattaggaggaacaccagtggcgaaggcggcttactggacgataactgacgc<br>tgaggctcgaaagcgtggggagcaaacaggattagataccctggtagtccacgctgtaaacgatgaatactaggtgttgggaa<br>gcattgcttctcggtgccgtcgcaaacgcagtaagtattccacctggggagtacgttcgcaagaatgaaactcaaaggaattga<br>cggggacccgcacaagcggtggagcatgtggtttaattcgaagcaacgcgaagaaccttaccaagtcttgacatccttctgac<br>cggtacttaaccgtaccttctcttcggagcaggagtgacaggtggtgcatggttgtcgtcagctcgtgtcgtgagatgttgggtta<br>agtcccgcaacgagcgcaacccttatctttagtagccagcggtctggccgggcactctagagagactgccagggataacctg<br>gaggaaggcggggatgacgtcaaatcatcatgccccttatgacttgggctacacacgtgctacaatggcgtaaacaaaggga |

TABLE 5-continued

Full length 16S rDNA sequences of species (negative correlates)

| Species Name | Sequence Identifier | 16S rDNA sequence |
| --- | --- | --- |
| | | agcgaagctgtgaagccgagcaaatctcaaaaataacgtctcagttcggactgtagtctgcaacccgactacacgaagctgga<br>atcgctagtaatcgcagatcagaatgctgcggtgaatacgttcccgggtcttgtacacaccgcccgtcacaccatgggagttgg<br>gaatgcccgaagccagtgacctaaccgaaaggaaggagctgtcgaaggcaggctcgataactggggtgaagtcgtaacaa<br>ggtagccgtatcggaaggtgcggctggatcacctccttt |
| *Eggerthella_ lenta* | SEQ ID NO: 39 | acggagagtttgatcctggctcaggatgaacgctggcggcgtgcctaacacatgcaagtcgaacgatgaaaccgccctcggg<br>cggacatgaagtggcgaacgggtgagtaacacgtgaccaacctgccccttgctccgggacaaccttgggaaaccgaggcta<br>ataccggatactcctcgcccccctcctgggggcccgggaaagcccagacggcaagggatggggtcgcggcccattaggt<br>agtaggcggggtaacggcccacctagcccgcgatgggtagccgggttgagagaccgaccggccacattgggactgagata<br>cggcccagactcctacgggaggcagcagtggggaattttgcgcaatgggggaaaccctgacgcagcaacgccgcgtgcgg<br>gacgacggccttcgggttgtaaaccgctttcagcagggaagaaattcgacggtacctgcagaagaagctccggctaactacgt<br>gccagcagccgcggtaatacgtagggagcgagcgttatccggattcattgggcgtaaagagcgcgtaggcggcctctcaag<br>cgggatctctaatccgagggctcaaccccggccggatcccgaactgggaggctcgagttcggtagaggcaggcggaattc<br>ccggtgtagcggtggaatgcgcagatatcgggaagaacaccgatggcgaaggcagcctgctgggccgcaactgacgctga<br>ggcgcgaaagctaggggagcgaacaggattagataccctggtagtcctagccgtaaacgatggatactaggtgtggggggc<br>tccgccctccgtgccgcagccaacgcattaagtatcccgcctggggagtacggccgcaaggctaaaactcaaaggaattgac<br>gggggcccgcacaagcagcggagcatgtggcttaattcgaagcaacgcgaagaaccttaccagggcttgacatggacgtga<br>agccggggaaacccggtggccgagaggagcgtccgcaggtggtgcatggctgtcgtcagctcgtgtcgtgagatgttgggtt<br>aagtcccgcaacgagcgcaacccctgccccatgttgccagcattaggttggggactcatgggggactgccggcgtcaagcc<br>ggaggaaggtggggacgacgtcaagtcatcatgccctttatgccctgggctgcacacgtgctacaatggccggtacaacggg<br>ctgcgagaccgcgaggtcgagcgaatccctcaaagccggccccagttcggatcggaggctgcaacccgcctccgtgaagtc<br>ggagttgctagtaatcgcggatcagcatgccgcggtgaatacgttcccgggccttgtacacaccgcccgtcacaccacccga<br>gtcgtctgcacccgaagccgccggccgaacccgcaaggggcggaggcgtcgaaggtgtggagggtaagggggggtgaag<br>tcgtaacaaggtagccgtaccggaaggtgcggctggatcacctccttt |
| *Eggerthella_ lenta* | SEQ ID NO: 40 | acggagagtttgatcctggctcaggatgaacgctggcggcgtgcctaacacatgcaagtcgaacgatgaaaccgccctcggg<br>cggacatgaagtggcgaacgggtgagtaacacgtgaccaacctgccccttgctccgggacaaccttgggaaaccgaggcta<br>ataccggatactcctcgcccccctcctgggggcccgggaaagcccagacggcaagggatggggtcgcggcccattaggt<br>agtaggcggggtaacggcccacctagcccgcgatgggtagccgggttgagagaccgaccggccacattgggactgagata<br>cggcccagactcctacgggaggcagcagtggggaattttgcgcaatgggggaaaccctgacgcagcaacgccgcgtgcgg<br>gacgacggccttcgggttgtaaaccgctttcagcagggaagaaattcgacggtacctgcagaagaagctccggctaactacgt<br>gccagcagccgcggtaatacgtagggagcgagcgttatccggattcattgggcgtaaagagcgcgtaggcggcctctcaag<br>cgggatctctaatccgagggctcaaccccggccggatcccgaactgggaggctcgagttcggtagaggcaggcggaattc<br>ccggtgtagcggtggaatgcgcagatatcgggaagaacaccgatggcgaaggcagcctgctgggccgcaactgacgctga<br>ggcgcgaaagctaggggagcgaacaggattagataccctggtagtcctagccgtaaacgatggatactaggtgtggggggc<br>tccgccctccgtgccgcagccaacgcattaagtatcccgcctggggagtacggccgcaaggctaaaactcaaaggaattgac<br>gggggcccgcacaagcagcggagcatgtggcttaattcgaagcaacgcgaagaaccttaccagggcttgacatggacgtga<br>agccggggaaacccggtggccgagaggagcgtccgcaggtggtgcatggctgtcgtcagctcgtgtcgtgagatgttgggtt<br>aagtcccgcaacgagcgcaacccctgccccatgttgccagcattaggttggggactcatgggggactgccggcgtcaagcc<br>ggaggaaggtggggacgacgtcaagtcatcatgccctttatgccctgggctgcacacgtgctacaatggccggtacaacggg<br>ctgcgagaccgcgaggtcgagcgaatccctcaaagccggccccagttcggatcggaggctgcaacccgcctccgtgaagtc<br>ggagttgctagtaatcgcggatcagcatgccgcggtgaatacgttcccgggccttgtacacaccgcccgtcacaccacccga<br>gtcgtctgcacccgaagccgccggccgaacccgcaaggggcggaggcgtcgaaggtgtggagggtaagggggggtgaag<br>tcgtaacaaggtagccgtaccggaaggtgcggctggatcacctccttt |
| *Eggerthella_ lenta* | SEQ ID NO: 41 | acggagagtttgatcctggctcaggatgaacgctggcggcgtgcctaacacatgcaagtcgaacgatgaaaccgccctcggg<br>cggacatgaagtggcgaacgggtgagtaacacgtgaccaacctgccccttgctccgggacaaccttgggaaaccgaggcta<br>ataccggatactcctcgcccccctcctgggggcccgggaaagcccagacggcaagggatggggtcgcggcccattaggt |

TABLE 5-continued

| Full length 16S rDNA sequences of species (negative correlates) | | |
|---|---|---|
| Species Name | Sequence Identifier | 16S rDNA sequence |
| | | agtaggcggggtaacggcccacctagcccgcgatgggtagccgggttgagagaccgaccggccacattgggactgagata<br>cggcccagactcctacgggaggcagcagtggggaattttgcgcaatgggggaaaccctgacgcagcaacgccgcgtgcgg<br>gacgacggccttcgggttgtaaaccgctttcagcagggaagaaattcgacggtacctgcagaagaagaccggctaactacgt<br>gccagcagccgcggtaatacgtagggagcgagcgttatccggattcattgggcgtaaagagcgcgtaggcggcctctcaag<br>cgggatctctaatccgagggctcaaccccccggccggatcccgaactgggaggctcgagttcggtagaggcaggcggaattc<br>ccggtgtagcggtggaatgcgcagatatcgggaagaacaccgatggcgaaggcagcctgctgggccgcaactgacgctga<br>ggcgcgaaagctaggggagcgaacaggattagataccctggtagtcctagccgtaaacgatggatactaggtgtggggggc<br>tccgccctccgtgccgcagccaacgcattaagtatcccgcctggggagtacggccgcaaggctaaaactcaaaggaattgac<br>gggggcccgcacaagcagcggagcatgtggcttaattcgaagcaacgcgaagaaccttaccagggcttgacatggacgtga<br>agccggggaaacccggtggccgagaggagcgtccgcaggtggtgcatggctgtcgtcagctcgtgtcgtgagatgttgggtt<br>aagtcccgcaacgagcgcaacccctgccccatgttgccagcattaggttggggactcatgggggactgccggcgtcaagcc<br>ggaggaaggtggggacgacgtcaagtcatcatgccctttatgccctgggctgcacacgtgctacaatggccggtacaacggg<br>ctgcgagaccgcgaggtcgagcgaatccctcaaagccggccccagttcggatcggaggctgcaacccgcctccgtgaagtc<br>ggagttgctagtaatcgcggatcagcatgccgcggtgaatacgttcccgggccttgtacacaccgcccgtcacaccacccga<br>gtcgtctgcacccgaagccgccggccgaacccgcaaggggcggaggcgtcgaaggtgtggagggtaagggggtgaag<br>tcgtaacaaggtagccgtaccggaaggtgcggctggatcacctccttt |
| *Burkholderi ales_bacteri um_1_1_47* | SEQ ID NO: 42 | atagagtttgatcctggctcagattgaacgctggcggaacgctttacacatgcaagtcgaacggtaacgcgggagaagcttgct<br>tctcccggcgacgagtggcgaacgggtgagtaatacatcggaacgtgtccgctcgtgggggacaaccagccgaaaggttgg<br>ctaataccgcatgagttctacggaagaaagagggggacccgcaagggcctctcgcgagcggagcggccgatgactgattag<br>ccggttggtgaggtaacggctcaccaaagcaacgatcagtagctggtctgagaggacgaccagccacactgggactgagac<br>acggcccagactcctacgggaggcagcagtggggaattttggacaatgggcgcaagcctgatccagctattccgcgtgtggg<br>atgaaggccctcgggttgtaaaccacttttgtagagaacgaaaagacaccttcgaataaagggtgttgctgacggtactctaag<br>aataagcaccggctaactacgtgccagcagccgcggtaatacgtagggtgcgagcgttaatcggaattactgggcgtaaagg<br>gtgcgcaggcggttgagtaagacagatgtgaaatccccgagcttaactcgggaatggcatatgtgactgctcgactagagtgt<br>gtcagagggaggtggaattccacgtgtagcagtgaaatgcgtagatatgtggaagaacaccgatggcgaaggcagcctcctg<br>ggacataactgacgctcaggcacgaaagcgtggggagcaaacaggattagataccctggtagtccacgccctaaacgatgtt<br>aactagttgttgggaagtaaaattctcagtaacgcagccaacgcgagaagttaaccgcctgggaagtacggtcgcaagactaa<br>aactcaaaggaattgacggggacccgcacaagcggtggatgatgtggattaattcgatgcaacgcgaaaaaccttacctaccc<br>ttgacatgtcaggaagacttgtaatgagagtgtgcccgcaagggagcctgaacacaggtgctgcatggctgtcgtcagacgt<br>gtcgtgagatgttgggttaagtcccgcaacgagcgcaacccttgtcactagttgctacgaaagggcactctagtgagactgccg<br>gtgacaaaccggaggaaggtggggatgacgtcaagtcctcatggcccttatgggtagggcttcacacgtcatacaatggtcg<br>gaacagagggcagcgaagtcgtgagacggagccaatcccagaaaaccgatcgtagtccggattgcagtctgcaactcgact<br>gcatgaagtcggaatcgctagtaatcgcggatcagcatgccgcggtgaatacgttcccgggtcttgtacacaccgcccgtcaa<br>acaatgggagtggtgtttaccagaagtcgttagcctaaccgcaaggagggcggcgaccacggtgagcaccgtgactaatgtt<br>aagtcgtaacaaggtagccgtaccggaaggtgcggctggatcacctccttt |
| *Eubacterium _eligens* | SEQ ID NO: 43 | ttatgagagtttgatcctggctcaggatgaacgctggcggcgtgcttaacacatgcaagtcgaacgaagcatttagaacagatta<br>cttcggtttgaagttctttatgactgagtggcggacgggtgagtaacgcgtgggtaacctgccttgtactgggggatagcagctg<br>gaaacggctggtaataccgcataagcgcacaatgttgcatgacatggtgtgaaaaactccggtggtataagatggacccgcgt<br>ctgattagctagttggtgagataacagcccaccaaggcgacgatcagtagccgacctgagagggtgaccggccacattggga<br>ctgagacacggcccagactcctacgggaggcagcagtggggaatattgcacaatggaggaaactctgatgcagcgacgcc<br>gcgtgagtgaagaagtaattcgttatgtaaagctctatcagcagggaagatagtgacggtacctgactaagaagctccggctaa<br>atacgtgccagcagccgcggtaatacgtatggagcaagcgttatccggatttactgggtgtaaagggagtgtaggtggccatg<br>caagtcagaagtgaaaatccggggctcaaccccggaactgcttttgaaactgtaaggctggagtgcaggaggggtgagtgga<br>attcctagtgtagcggtgaaatgcgtagatattaggaggaacaccagtggcgaaggcggctcactggactgtaactgacactg<br>aggctcgaaagcgtggggagcaaacaggattagataccctggtagtccacgccgtaaacgatgaatactaggtgtcggggc<br>ccataagggcttcggtgccgcagcaaacgcaataagtattccacctggggagtacgttcgcaagaatgaaactcaaaggaatt |

TABLE 5-continued

Full length 16S rDNA sequences of species (negative correlates)

| Species Name | Sequence Identifier | 16S rDNA sequence |
|---|---|---|
| | | gacggggacccgcacaagcggtggagcatgtggtttaattcgaagcaacgcgaagaaccttaccaagtcttgacatcctcttg<br>accggtcagtaatgtggcctttccttcgggacaagagagacaggtggtgcatggttgtcgtcagctcgtgtcgtgagatgttgg<br>gttaagtcccgcaacgagcgcaacccctatccttagtagccagcagtaagatgggcactctagggagactgccagggataac<br>ctggaggaaggtggggatgacgtcaaatcatcatgccccttatgacttgggctacacacgtgctacaatggcgtaaacaaagt<br>gaagcgaagtcgtgaggccaagcaaatcacaaaaataacgtctcagttcggattgtagtctgcaactcgactacatgaagctg<br>gaatcgctagtaatcgcagatcagaatgctgcggtgaatacgttcccgggtcttgtacacaccgcccgtcacaccatgggagte<br>gaaaatgcccgaagtcggtgacctaacgtaagaaggagccgccgaaggcaggtttgataactggggtgaagtcgtaacaag<br>gtagccgtatcggaaggtgcggctggatcacctccttt |
| *Eubacterium _eligens* | SEQ ID NO: 44 | ttatgagagtttgatcctggctcaggatgaacgctggcggcgtgcttaacacatgcaagtcgaacgaagcatttagaacagatta<br>tttcggtatgaagttctttatgactgagtggcggacgggtgagtaacgcgtgggtaacctgccttgtactggggatagcagctg<br>gaaacggctggtaataccgcataagcgcacaatgttgcatgacatggtgtgaaaaactccggtggtataagatggacccgcgt<br>ctgattagctagttggtgagataacagcccaccaaggcgacgatcagtagccgacctgagagggtgaccggccacattggga<br>ctgagacacggcccagactcctacgggaggcagcagtggggaatattgcacaatggaggaaactctgatgcagcgacgcc<br>gcgtgagtgaagaagtaattcgttatgtaaagctctatcagcagggaagatagtgacggtacctgactaagaagctccggctaa<br>atacgtgccagcagccgcggtaatacgtatggagcaagcgttatccggatttactgggtgtaaagggagtgtaggtggccatg<br>caagtcagaagtgaaaatccggggctcaaccccggaactgcttttgaaactgtaaggctggagtgcaggaggggtgagtgga<br>attcctagtgtagcggtgaaatgcgtagatattaggaggaacaccagtggcgaaggcggctcactggactgtaactgacactg<br>aggctcgaaagcgtggggagcaaacaggattagataccctggtagtccacgccgtaaacgatgaatactaggtgtcggggc<br>ccaaaagggcttcggtgccgcagcaaacgcaataagtattccacctggggagtacgttcgcaagaatgaaactcaaaggaatt<br>gacggggacccgcacaagcggtggagcatgtggtttaattcgaagcaacgcgaagaaaccttaccaagtcttgacatcccact<br>gaccggacagtaatgtgtcctttccttcgggacagtggtgacaggtggtgcatggttgtcgtcagctcgtgtcgtgagatgttgg<br>gttaagtcccgcaacgagcgcaacccctatccttagtagccagcagtaagatgggcactctagggagactgccagggataac<br>ctggaggaaggtggggatgacgtcaaatcatcatgccccttatgacttgggctacacacgtgctacaatggcgtaaacaaagt<br>gaagcgaagtcgtgaggccaagcaaatcacaaaaataacgtctcagttcggattgtagtctgcaactcgactacatgaagctg<br>gaatcgctagtaatcgcagatcagaatgctgcggtgaatacgttcccgggtcttgtacacaccgcccgtcacaccatgggagtc<br>gaaaatgcccgaagtcggtgacctaacgtaagaaggagccgccgaaggcaggtttgataactggggtgaagtcgtaacaag<br>gtagccgtatcggaaggtgcggctggatcacctccttt |
| *Eubacterium _eligens* | SEQ ID NO: 45 | ttatgagagtttgatcctggctcaggatgaacgctggcggcgtgcttaacacatgcaagtcgaacgaagcatttagaacagatta<br>tttcggtatgaagttctttatgactgagtggcggacgggtgagtaacgcgtgggtaacctgccttgtactgggggatagcagctg<br>gaaacggctggtaataccgcataagcgcacaatgttgcatgacatagtgtgaaaaactccggtggtataagatggacccgcgt<br>ctgattagctagttggtgagataacagcccaccaaggcgacgatcagtagccgacctgagagggtgaccggccacattggga<br>ctgagacacggcccagactcctacgggaggcagcagtggggaatattgcacaatggaggaaactctgatgcagcgacgcc<br>gcgtgagtgaagaagtaattcgttatgtaaagctctatcagcagggaagatagtgacggtacctgactaagaagctccggctaa<br>atacgtgccagcagccgcggtaatacgtatggagcaagcgttatccggatttactgggtgtaaagggagtgtaggtggccatg<br>caagtcagaagtgaaaatccggggcttaaccccggaactgcttttgaaactgtaaggctggagtgcaggaggggtgagtgga<br>attcctagtgtagcggtgaaatgcgtagatattaggaggaacaccagtggcgaaggcggctcactggactgtaactgacactg<br>aggctcgaaagcgtggggagcaaacaggattagataccctggtagtccacgccgtaaacgatgaatactaggtgtcggggc<br>ccataagggcttcggtgccgcagcaaacgcaataagtattccacctggggagtacgttcgcaagaatgaaactcaaaggaatt<br>gacggggacccgcacaagcggtggagcatgtggtttaattcgaagcaacgcgaagaaccttaccaagtcttgacatcccact<br>gaccggacagtaatgtgtcctttccttcgggacagtggtgacaggtggtgcatggttgtcgtcagctcgtgtcgtgagatgttgg<br>gttaagtcccgcaacgagcgcaacccctatccttagtagccagcagtaagatgggcactctagggagactgccagggataac<br>ctggaggaaggtggggatgacgtcaaatcatcatgccccttatgacttgggctacacacgtgctacaatggcgtaaacaaagt<br>gaagcgaagtcgtgaggccaagcaaatcacaaaaataacgtctcagttcggattgtagtctgcaactcgactacatgaagctg<br>gaatcgctagtaatcgcagatcagaatgctgcggtgaatacgttcccgggtcttgtacacaccgcccgtcacaccatgggagtc<br>gaaaatgcccgaagtcggtgacctaacgaaagaaggagccgccgaaggcaggtttgataactggggtgaagtcgtaacaag<br>gtagccgtatcggaaggtgcggctggatcacctccttt |

TABLE 5-continued

Full length 16S rDNA sequences of species (negative correlates)

| Species Name | Sequence Identifier | 16S rDNA sequence |
|---|---|---|
| *Eubacterium _eligens* | SEQ ID NO: 46 | ttatgagagtttgatcctggctcaggatgaacgctggcggcgtgcttaacacatgcaagtcgaacgaagcatttagaacagatta<br>tttcggtatgaagttctttatgactgagtggcggacgggtgagtaacgcgtgggtaacctgccttgtactgggggatagcagctg<br>gaaacggctggtaataccgcataagcgcacaatgttgcatgacatggtgtgaaaaactccggtggtataagatggacccgcgt<br>ctgattagctagttggtgagataacagcccaccaaggcgacgatcagtagccgacctgagagggtgaccggccacattggga<br>ctgagacacggcccagactcctacgggaggcagcagtggggaatattgcacaatggaggaaactctgatgcagcgacgcc<br>gcgtgagtgaagaagtaattcgttatgtaaagctctatcagcagggaagatagtgacggtacctgactaagaagctccggctaa<br>atacgtgccagcagccgcggtaatacgtatggagcaagcgttatccggatttactgggtgtaaagggagtgtaggtggccatg<br>caagtcagaagtgaaaatccggggctcaaccccggaactgcttttgaaactgtgaggctggagtgcaggaggggtgagtgg<br>aattcctagtgtagcggtgaaatgcgtagatattaggaggaacaccagtggcgaaggcggctcactggactgtaactgacact<br>gaggctcgaaagcgtggggagcaaacaggattagataccctggtagtccacgccgtaaacgatgaatactaggtgtcgggg<br>cccataagggcttcggtgccgcagcaaacgcaataagtattccacctggggagtacgttcgcaagaatgaaactcaaaggaat<br>tgacggggacccgcacaagcggtggagcatgtggtttaattcgaagcaacgcgaagaaccttaccaagtcttgacatcccact<br>gaccggacagtaatgtgtcctttccttcgggacagtggagacaggtggtgcatggttgtcgtcagctcgtgtcgtgagatgttgg<br>gttaagtcccgcaacgagcgcaacccctatccttagtagccagcagtaagatgggcactctagggagactgccagggataac<br>ctggaggaaggtggggatgacgtcaaatcatcatgccccttatgacttgggctacacacgtgctacaatggcgtaaacaaagt<br>gaagcaaagtcgtgaggccaagcaaatcacaaaaataacgtctcagttcggattgtagtctgcaactcgactacatgaagctgg<br>aatcgctagtaatcgcagatcagaatgctgcggtgaatacgttcccgggtcttgtacacaccgcccgtcacaccatgggagtcg<br>aaaatgcccgaagtcggtgacctaacgcaagaaggagccgccgaaggcaggtttgataactggggtgaagtcgtaacaagg<br>tagccgtatcggaaggtgcggctggatcacctccttt |
| *Eubacterium _eligens* | SEQ ID NO: 47 | ttatgagagtttgatcctggctcaggatgaacgctggcggcgtgcttaacacatgcaagtcgaacgaagcatttgcgacagattt<br>tttcggaatgaagttgcttatgactgagtggcggacgggtgagtaacgcgtgggtaacctgccttgtactgggggatagcagct<br>ggaaacggctggtaataccgcataagcgcacaatgttgcatgacatggtgtgaaaaactccggtggtataagatggacccgc<br>gtctgattagctagttggtgagataacagcccaccaaggcgacgatcagtagccgacctgagagggtgaccggccacattgg<br>gactgagacacggcccagactcctacgggaggcagcagtggggaatattgcacaatggaggaaactctgatgcagcgacg<br>ccgcgtgagtgaagaagtaattcgttatgtaaagctctatcagcagggaagatagtgacggtacctgactaagaagctccggct<br>aaatacgtgccagcagccgcggtaatacgtatggagcaagcgttatccggatttactgggtgtaaagggagtgtaggtggcca<br>tgcaagtcagaagtgaaaatccggggctcaaccccggaactgcttttgaaactgtaaggctggagtgcaggaggggtgagtg<br>gaattcctagtgtagcggtgaaatgcgtagatattaggaggaacaccagtggcgaaggcggctcactggactgtaactgacac<br>tgaggctcgaaagcgtggggagcaaacaggattagataccctggtagtccacgccgtaaacgatgaatactaggtgtcgggg<br>cccataagggcttcggtgccgcagcaaacgcaataagtattccacctggggagtacgttcgcaagaatgaaactcaaaggaat<br>tgacggggacccgcacaagcggtggagcatgtggtttaattcgaagcaacgcgaagaaccttaccaagtcttgacatcccact<br>gaccggacagtaatgtgtcctttccttcgggacagtggagacaggtggtgcatggttgtcgtcagctcgtgtcgtgagatgttgg<br>gttaagtcccgcaacgagcgcaacccctatccttagtagccagcagtaagatgggcactctagggagactgccagggataac<br>ctggaggaaggtggggatgacgtcaaatcatcatgccccttatgacttgggctacacacgtgctacaatggcgtaaacaaagt<br>gaagcgaagtcgtgaggccaagcaaatcacaaaaataacgtctcagttcggattgtagtctgcaactcgactacatgaagctg<br>gaatcgctagtaatcgcagatcagaatgctgcggtgaatacgttcccgggtcttgtacacaccgcccgtcacaccatgggagtc<br>gaaaatgcccgaagtcggtgacctaacgtaagaaggagccgccgaaggcaggtttgataactggggtgaagtcgtaacaag<br>gtagccgtatcggaaggtgcggctggatcacctccttt |
| *Eubacterium _ventriosum* | SEQ ID NO: 48 | aacgagagtttgatcctggctcaggatgaacgctggcggcgtgcttaatacatgcaagtcgaacgaagcaccttggacagaat<br>ccttcgggaggaagaccattgtgactgagtggcggacgggtgagtaacgcgtgggtaacctgccttgtacagggggataaca<br>gttggaaacgactgctaataccgcataagcgcacagtaccgcatggtacggtgtgaaaaactccggtggtacaagatggacc<br>cgcgtctgattagctggttggtgaggtaacggcccaccaaggcgacgatcagtagccgacttgagagagtgatcggccacatt<br>gggactgagacacggcccaaactcctacgggaggcagcagtagggaatattgcacaatgggggaaaccctgatgcagcga<br>cgccgcgtgaaggaagaagtatttcggtatgtaaacttctatcagcaaggaagaaaatgacggtacttgactaagaagccccg<br>gctaaatacgtgccagcagccgcggtaatacgtatggggcaagcgttatccggatttactgggtgtaaagggagcgtaggcg |

TABLE 5-continued

Full length 16S rDNA sequences of species (negative correlates)

| Species Name | Sequence Identifier | 16S rDNA sequence |
|---|---|---|
| | | gcatggcaagtcagaagtgaaagcctggggctcaaccccggaattgcttttgaaactgtcaggctagagtgtcggaggggta<br>agcggaattcctagtgtagcggtgaaatgcgtagatattaggaggaacaccggtggcgaaggcggcttactggacgattactg<br>acgctgaggctcgaaagcgtggggagcaaacaggattagataccctggtagtccacgccgtaaacgatgaatactaggtgtc<br>gggggacaatagttcctcggtgccgaagcaaacgcattaagtattccacctggggagtacgttcgcaagaatgaaactcaaag<br>gaattgacggggacccgcacaagcggtggagcatgtggtttaattcgaagcaacgcgaagaaccttacctgctcttgacatcc<br>cactgacaggtcagtaatgtgaccctttcttcggaacagtggagacaggtggtgcatggttgtcgtcagctcgtgtcgtgagatg<br>ttgggttaagtcccgcaacgagcgcaacccttgtctttagtagccagcagtacggctgggcactctagagagactgccaggga<br>taacctggaggaaggcggggatgacgtcaaatcatcatgccccttacgagcagggctacacacgtgctacaatggcgtaaac<br>aaagggaagcgaccccgtgagggtaagcaaatctcaaaaataacgtctcagttcggattgtagtctgcaactcgactacatgaa<br>gctggaatcgctagtaatcgcgaatcagaatgtcgcggtgaatacgttcccgggtcttgtacacaccgcccgtcacaccatgg<br>gagttggatatgcccgaagtcagtgacccaaccgtaaggagggagctgccgaaggtggagccgataactggggtgaagtcg<br>taacaaggtagccgtatcggaaggtgcggctggatcacctccttt |
| *Ruminococcus_obeum* | SEQ ID NO: 49 | tcagagagtttgatcctggctcaggatgaacgctggcggcgtgcttaacacatgcaagtcgaacgggaaacttttcattgaagc<br>ttcggcagatttggtctgtttctagtggcggacgggtgagtaacgcgtgggtaacctgccttatacaggggataacaaccaga<br>aatggttgctaataccgcataagcgcacaggaccgcatggtccggtgtgaaaaactccggtggtataagatggacccgcgttg<br>gattagctagttggcagggtaacggcctaccaaggcgacgatccatagccggcctgagagggtgaacggccacattgggac<br>tgagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggactg<br>gcaagtctgatgtgaaaggcgggggctcaacccctggactgcattggaaactgttagtcttgagtgccggagaggtaagcgg<br>aattcctagtgtagcggtgaaatgcgtagatattaggaggaacaccagtggcgaaggcggcttactggacggtaactgacgtt<br>gaggctcgaaagcgtggggagcaaacaggattagataccctggtagtccacgccgtaaacgatgaatactaggtgttgggga<br>gcaaagctcttcggtgccgccgcaaacgcattaagtattccacctggggagtacgttcgcaagaatgaaactcaaaggaattg<br>acggggacccgcacaagcggtggagcatgtggtttaattcgaagcaacgcgaagaaccttaccaagtcttgacatccctctga<br>ccgttccttaaccggaactttccttcgggacagaggagacaggtggtgcatggttgtcgtcagctcgtgtcgtgagatgttgggt<br>taagtcccgcaacgagcgcaacccctatccccagtagccagcggttcggccgggcactctgaggagactgccagggataac<br>ctggaggaaggcggggatgacgtcaaatcatcatgccccttatgatttgggctacacacgtgctacaatggcgtaaacaaagg<br>gaagcgagcctgcgaaggtaagcaaatcccaaaaataacgtcccagttcggactgcagtctgcaactcgactgcacgaagct<br>ggaatcgctagtaatcgcggatcagaatgccgcggtgaatacgttcccgggtcttgtacacaccgcccgtcacaccatgggag<br>tcagtaacgcccgaagtcagtgacctaactgcaaagaaggagctgccgaaggcgggaccgatgactggggtgaagtcgtaa<br>caaggtagccgtatcggaaggtgcggctggatcacctccttt |
| *Ruminococcus_obeum* | SEQ ID NO: 50 | tcagagagtttgatcctggctcaggatgaacgctggcggcgtgcttaacacatgcaagtcgaacgggaaacttttcattgaagc<br>ttcggcagatttggtctgatctagtggcggacgggtgagtaacgcgtgggtaacctgccttatacaggggataacaaccaga<br>aatggttgctaataccgcataagcgcacaggaccgcatggtctagtgtgaaaaactccggtggtataagatggacccgcgttg<br>gattagctagttggcagggtaacggcctaccaaggcgacgatccatagccggcctgagagggtgaacggccacattgggac<br>tgagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggactg<br>gcaagtctgatgtgaaaggcgggggctcaacccctggactgcattggaaactgttagtcttgagtgccggagaggtaagcgg<br>aattcctagtgtagcggtgaaatgcgtagatattaggaggaacaccagtggcgaaggcggcttactggacggtaactgacgtt<br>gaggctcgaaagcgtggggagcaaacaggattagataccctggtagtccacgccgtaaacgatgaatactaggtgttgggga<br>gcaaagctcttcggtgccgccgcaaacgcattaagtattccacctggggagtacgttcgcaagaatgaaactcaaaggaattg<br>acggggacccgcacaagcggtggagcatgtggtttaattcgaagcaacgcgaagaaccttaccaagtcttgacatccctctga<br>ccgttccttaaccggaactttccttcgggacaggggagacaggtggtgcatggttgtcgtcagctcgtgtcgtgagatgttgggt<br>taagtcccgcaacgagcgcaacccctatccccagtagccagcagtccggctgggcactctgaggagactgccagggataac<br>ctggaggaaggcggggatgacgtcaaatcatcatgccccttatgatttgggctacacacgtgctacaatggcgtaaacaaagg |

TABLE 5-continued

Full length 16S rDNA sequences of species (negative correlates)

| Species Name | Sequence Identifier | 16S rDNA sequence |
|---|---|---|
| | | gaagcaagcctgcgaaggtaagcaaatcccaaaaataacgtcccagttcggactgcagtctgcaactcgactgcacgaagct<br>ggaatcgctagtaatcgcggatcagaatgccgcggtgaatacgttcccgggtcttgtacacaccgcccgtcacaccatgggag<br>tcagtaacgcccgaagtcagtgacctaactgcaaagaaggagctgccgaaggcgggaccgatgactggggtgaagtcgtaa<br>caaggtagccgtatcggaaggtgcggctggatcacctccttt |
| *Ruminococc us_obeum* | SEQ ID NO: 51 | gacacggcccagactcctacgggaggcagcagtggggaatattgtacaatgggggaaaccctgatgcagcgacgccgcgt<br>gaaggaagaagtatctcggtatgtaaacttctatcagcagggaagatagtgacggtacctgactaagaagccccggctaacta<br>cgtgccagcagccgcggtaatacgtagggggcaagcgttatccggatttactgggtgtaaagggagcgtagacggactggc<br>aagtctgatgtgaaaggcgggggctcaacccctggactgcattggaaactgttagtcttgagtgccggagaggtaagcggaat<br>tcctagtgtagcggtgaaatgcgtagatattaggaggaacaccagtggcgaaggcggcttactggacggtaactgacgttgag<br>gctcgaaagcgtggggagcaaacaggattagataccctggtagtccacgccgtaaacgatgaatactaggtgttggggagca<br>aagctcttcggtgccgccgcaaacgcattaagtattccacctggggagtacgttcgcaagaatgaaactcaaaggaattgacg<br>gggacccgcacaagcggtggagcatgtggtttaattcgaagcaacgcgaagaaccttaccaagtcttgacatccctctgaccg<br>actcttaaccgagtctttccttcgggacaggggagacaggtggtgcatggttgtcgtcagctcgtgtcgtgagatgttgggttaa<br>gtcccgcaacgagcgcaacccctatccccagtagccagcagtccggctgggcactctgaggagactgccagggataacctg<br>gaggaaggcggggatgacgtcaaatcatcatgccccttatgatttgggctacacacgtgctacaatggcgtaaacaaagggaa<br>gcaagcctgcgaaggtaagcaaatccccaaaaataacgatcccagttcggactgctgtctgcaactcgactgcacgaagag<br>gaattcgctagtaatcgcggatcaaatgccgcggtgaatacgttcccgggatctgtacacacccgcccgtccatccttgggagt<br>ctgtacccccgatttagtggacctacc |
| *Ruminococc us_obeum* | SEQ ID NO: 52 | tcagagagtttgatcctggctcaggatgaacgctggcggcgtgcttaacacatgcaagtcgaacgggaaacttttcattgaagc<br>ttcggcagatttggtctgtttctagtggcggacgggtgagtaacgcgtgggtaacctgccttatacagggggataacaaccaga<br>aatggttgctaataccgcataagcgcacaggaccgcatggtccggtgtgaaaaactccggtggtataagatggacccgcgttg<br>gattagctagttggcagggtaacggcctaccaaggcgacgatccatagccggcctgagagggtgaacggccacattgggac<br>tgagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggactg<br>gcaagtctgatgtgaaaggcgggggctcaacccctggactgcattggaaactgttagtcttgagtgccggagaggtaagcgg<br>aattcctagtgtagcggtgaaatgcgtagatattaggaggaacaccagtggcgaaggcggcttactggacggtaactgacgtt<br>gaggctcgaaagcgtggggagcaaacaggattagataccctggtagtccacgccgtaaacgatgaatactaggtgttgggga<br>gcaaagctcttcggtgccgccgcaaacgcattaagtattccacctggggagtacgttcgcaagaatgaaactcaaaggatttga<br>cgggggacccgcacagcggtggagcatgtggtttattcgagcacggcgaagaaccttaccaagtctgacatcccct |
| *Ruminococc us_obeum* | SEQ ID NO: 53 | tcagagagtttgatcctggctcaggatgaacgctggcggcgtgcttaacacatgcaagtcgaacgggaaaccttttattgaagc<br>ttcggcagatttagctggtttctagtggcggacgggtgagtaacgcgtgggtaacctgccttatacagggggataacaaccaga<br>aatggttgctaataccgcataagcgcacaggaccgcatggtccggtgtgaaaaactccggtggtataagatggacccgcgttg<br>gattagctagttggcagggtaacggcctaccaaggcgacgatccatagccggcctgagagggtgaacggccacattgggac<br>tgagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggactg<br>gcaagtctgatgtgaaaggcgggggctcaacccctggactgcattggaaactgttagtcttgagtgccggagaggtaagcgg<br>aattcctagtgtagcggtgaaatgcgtagatattaggaggaacaccagtggcgaaagcggcttactggacggtaactgacgtt<br>gaggctcgaaagcgtggggagcaaacaggattagatacctggtagtccacgccgtaaacgatgaatactagtgttgggggag<br>caaagctcttcgtgccgccgcaaacgcattagtattccacctggggagtacgttcgcaagaatgaaactcaaaggaattgaccg<br>gcacccacaaacgcgtgagtcagggtgttaa |

TABLE 5-continued

| Full length 16S rDNA sequences of species (negative correlates) | | |
|---|---|---|
| Species Name | Sequence Identifier | 16S rDNA sequence |
| *Ruminococc us_torques* | SEQ ID NO: 54 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtggccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcccttcggggcagcggagacaggtggtgcatggttgtcgtcagctcgtgtcgtgagatgt<br>tgggttaagtcccgcaacgagcgcaacccctatctttagtagccagcggccaggccgggcactctagagagactgccgggg<br>ataacccggaggaaggtggggatgacgtcaaatcatcatgccccttatgagcagggctacacacgtgctacaatggcgtaaa<br>caaagggaagcgagaccgcgaggtggagcaaatcccaaaaataacgtctcagttcggattgtagtctgcaactcgactacatg<br>aagctggaatcgctagtaatcgcgaatcagaatgtcgcggtgaatacgttcccgggtcttgtacacaccgcccgtcacaccatg<br>ggagtcagtaacgcccgaagtcagtgacccaaccgtaaggagggagctgccgaaggcgggaccgataactggggtgaa<br>gtcgtaacaaggtagccgtatcggaaggtgcggctggatcacctccttt |
| *Ruminococc us_torques* | SEQ ID NO: 55 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcccttcggggcagcggagacaggtggtgcatggttgtcgtcagctcgtgtcgtgagatgt<br>tgggttaagtccccgcaacgagcgcaacccctatctttagtagccagcggccaggccgggcactctagagagactgccggg<br>gataacccggaggaaggtggggatgacgtcaaatcatcatgccccttatgagcagggctacacacgtgctacaatggcgtaa<br>acaaagggaagcgagaccgcgaggtggagcaaatcccaaaaataacgtctcagttcggattgtagtctgcaactcgactacat<br>gaagctggaatcgctagtaatcgcgaatcagaatgtcgcggtgaatacgttcccgggtcttgtacacaccgcccgtcacaccat<br>gggagtcagtaacgcccgaagtcagtgacccaaccgtaaggagggagctgccgaaggcgggaccgataactggggtgaa<br>gtcgtaacaaggtagccgtatcggaaggtgcggctggatcacctccttt |
| *Ruminococc us_torques* | SEQ ID NO: 56 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga |

TABLE 5-continued

| Species Name | Sequence Identifier | 16S rDNA sequence |
|---|---|---|
| Full length 16S rDNA sequences of species (negative correlates) | | |
| | | tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtgggagcatgtggtttaattcgaagcaacgcgaagaaccttacctgctcttgacatccc<br>gctgaccggacggtaatgcgtccttcccttcgggcagcggagacaggtggtgcatggttgtcgtcagct |
| *Ruminococc us_torques* | SEQ ID NO: 57 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtggccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccaggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcccttcggggcagcggagacaggtggtgcatggttgtcgtcagctcgtgtcgtgagatgt<br>tgggttaagtcccgcaacgagcgcaacccctatctttagtagccagcggccaggccgggcactctagagagactgccgggg<br>ataacccggaggaaggtggggatgacgtcaaatcatcatgccccttatgagcagggctacacacgtgctacaatggcgtaaa<br>caaagggaagcgagaccgcgaggtggagcaaatcccaaaaataacgtctcagttcggattgtagtctgcaactcgactacatg<br>aagctggaatcgctagtaatcgcgaatcagaatgtcgcggtgaatacgttcccgggtcttgtacacaccgcccgtcacaccatg<br>ggagtcagtaacgcccgaagtcagtgacccaaccgtaaggagggagctgccgaaggcgggaccgataactggggtgaa<br>gtcgtaacaaggtagccgtatcggaaggtgcggctggatcacctccttt |
| *Ruminococc us_torques* | SEQ ID NO: 58 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctggttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctgggggagtacgttcgcaagaatgaaactcaaagg<br>aattgacgggggacccgcacaagcggtggagcatgtggtttaattcgaagcaacgcgaagaaccttacctgctcttgacatcc<br>cgctgaccggacggtaatgcgtccttcccttcggggcagcggagacaggtggtgcatggttgtcgtcagctcgtgtcgtgaga<br>tgttgggttaagtcccgcacgagcgcaaccctatctttagtagcagcggccaggccgggcactctaaaagagactgccgggg<br>ataatcccgggaggaaggtggggat |
| *Ruminococc us_torques* | SEQ ID NO: 59 | tacgagagtttgatcctggctcaggatgaacgcgggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtggccggccacattgg<br>gactgagacacggcccaaactcctacgggaggcagcagtggggaatattgcacaatgggggaaaccctgatgcagcgacg |

TABLE 5-continued

Full length 16S rDNA sequences of species (negative correlates)

| Species Name | Sequence Identifier | 16S rDNA sequence |
|---|---|---|
| | | ccgcgtgagcgaagaagtatttcggtatgtaaagctctatcagcagggaagaaaatgacggtacctgactaagaagcaccgg ctaaatacgtgccagcagccgcggtaatacgtatggtgcaagcgttatccggatttactgggtgtaaagggagcgtagacgga tgggcaagtctgatgtgaaaacccggggctcaaccccgggactgcattggaaactgttcatctagagtgctggagaggtaagt ggaattcctagtgtagcggtgaaatgcgtagatattaggaggaacaccagtggcgaaggcggcttactggacagtaactgac gttgaggctcgaaagcgtggggagcaaacaggattagataccctggtagtccacgccgtaaacgatgactactaggtgtcgg gtggcaaagccattcggtgccgcagcaaacgcaataagtagtccacctggggagtacgttcgcaagaatgaaactcaaagga attgacggggacccgcacaagcggtggagcatgtggtttaattcgaagcaacgcgaagaaccttacctgctcttgacatcccg ctgaccggacggtaatgcgtccttcccttcggggcagcggagacaggtggtgcatggttgtcgtcagctcgtgtcgtgagatgt tgggttaagtcccgcaacgagcgcaacccctatctttagtagccagcggccaggccgggcactctagagagactgccgggg ataacccggaggaaggtggggatgacgtcaaatcatcatgccccttatgagcagggctacacacgtgctacaatggcgtaaa caaagggaagcgagaccgcgaggtggagcaaatcccaaaaataacgtctcagttcggattgtagtctgcaactcgactacatg aagctggaatcgctagtaatcgcgaatcagaatgtcgcggtgaatacgttcccgggtcttgtacacaccgcccgtcacaccatg ggagtcagtaacgcccgaagtcagtgacccaaccgtaaggagggagctgccgaaggcgggaccgataactggggtgaagt cgtaacaaggtagccgtatcggaaggtgcggctggatcacctccttt |
| *Dorea_longi catena* | SEQ ID NO: 60 | aacgagagtttgatcctggctcaggatgaacgctggcggcgtgcttaacacatgcaagtcgagcgaagcgcttaagtttgattc ttcggatgaagacttttgtgactgagcggcggacgggtgagtaacgcgtgggtaacctgcctcatacagggggataacagtta gaaatgactgctaataccgcataagaccacggtaccgcatggtacagtggtaaaaactccggtggtatgagatggacccgcgt ctgattaggtagttggtggggtaacggcctaccaagccgacgatcagtagccgacctgagagggtgaccggccacattggga ctgagacacggcccagactcctacgggaggcagcagtggggaatattgcacaatggaggaaactctgatgcagcgacgcc gcgtgaaggatgaagtatttcggtatgtaaacttctatcagcagggaagaaaatgacggtacctgactaagaagccccggcta actacgtgccagcagccgcggtaatacgtagggggcaagcgttatccggatttactgggtgtaaagggagcgtagacggcac ggcaagccagatgtgaaagcccggggctcaaccccgggactgcatttggaactgctgagctagagtgtcggagaggcaagt ggaattcctagtgtagcggtgaaatgcgtagatattaggaggaacaccagtggcgaaggcggcttgctggacgatgactgac gttgaggctcgaaagcgtggggagcaaacaggattagataccctggtagtccacgccgtaaacgatgactgctaggtgtcgg gtggcaaagccattcggtgccgcagctaacgcaataagcagtccacctggggagtacgttcgcaagaatgaaactcaaagga attgacggggacccgcacaagcggtggagcatgtggtttaattcgaagcaacgcgaagaaccttacctgatcttgacatcccg atgaccgcttcgtaatggaagttttcttcggaacatcggtgacaggtggtgcatggttgtcgtcagctcgtgtcgtgagatgttg ggttaagtcccgcaacgagcgcaacccctatcttcagtagccagcaggttaagctgggcactctggagagactgccagggat aacctggaggaaggtggggatgacgtcaaatcatcatgccccttatgaccagggctacacacgtgctacaatggcgtaaacaa agagaagcgaactcgcgagggtaagcaaatctcaaaaataacgtctcagttcggattgtagtctgcaactcgactacatgaagc tggaatcgctagtaatcgcagatcagaatgctgcggtgaatacgttcccgggtcttgtacacaccgcccgtcacaccatggga gtcagtaacgcccgaagtcagtgacccaaccgtaaggagggagagccgaaggtgggaccgataactggggtgaagtcgt aacaaggtagccgtatcggaaggtgcggctggatcacctccttt |
| *Dorea_longi catena* | SEQ ID NO: 61 | aacgagagtttgatcctggctcaggatgaacgctggcggcgtgcttaacacatgcaagtcgagcgaagcgctttggaaagatt cttcggatgatttcctttgtgactgagcggcggacgggtgagtaacgcgtgggtaacctgcctcatacagggggataacagtta gaaatgactgctaataccgcataagaccacggtaccgcatggtacagtggtaaaaactccggtggtatgagatggacccgcgt ctgattaggtagttggtggggtaacggcctaccaagccgacgatcagtagccgacctgagagggtgaccggccacattggga ctgagacacggcccagactcctacgggaggcagcagtggggaatattgcacaatggaggaaactctgatgcagcgacgcc gcgtgaaggatgaagtatttcggtatgtaaacttctatcagcagggaagaaaatgacggtacctgactaagaagccccggcta actacgtgccagcagccgcggtaatacgtagggggcaagcgttatccggatttactgggtgtaaagggagcgtagacggcac ggcaagccagatgtgaaagcccggggctcaaccccgggactgcatttggaactgctgagctagagtgtcggagaggcaagt ggaattcctagtgtagcggtgaaatgcgtagatattaggaggaacaccagtggcgaagcggcttgctggacgatgactgacgt tgaggctcgaaagcgtggggagcaaacaggattagataccctggtagtccacgccgtaaacgatgactgctaggtgtcgggt gg |

TABLE 5-continued

| Full length 16S rDNA sequences of species (negative correlates) | | |
|---|---|---|
| Species Name | Sequence Identifier | 16S rDNA sequence |
| *Anaerostipes_caccae* | SEQ ID NO: 62 | atgagagtttgatcctggctcaggatgaacgctggcggcgtgcttaacacatgcaagtcgaacgaagcatttaggattgaagttt<br>tcggatggatttcctatatgactgagtggcggacgggtgagtaacgcgtggggaacctgccctatacagggggataacagctg<br>gaaacggctgctaataccgcataagcgcacagaatcgcatgattcagtgtgaaaagccctggcagtataggatggtcccgcgt<br>ctgattagctggttggtgaggtaacggctcaccaaggcgacgatcagtagccggcttgagagagtgaacggccacattggga<br>ctgagacacggcccaaactcctacgggaggcagcagtggggaatattgcacaatgggggaaaccctgatgcagcgacgcc<br>gcgtgagtgaagaagtatttcggtatgtaaagctctatcagcagggaagaaaacagacggtacctgactaagaagccccggct<br>aactacgtgccagcagccgcggtaatacgtagggggcaagcgttatccggaattactgggtgtaaagggtgcgtaggtggca<br>tggtaagtcagaagtgaaagcccggggcttaaccccgggactgcttttgaaactgtcatgctggagtgcaggagaggtaagc<br>ggaattcctagtgtagcggtgaaatgcgtagatattaggaggaacaccagtggcgaaggcggcttactggactgtcactgaca<br>ctgatgcacgaaagcgtggggagcaaacaggattagataccctggtagtccacgccgtaaacgatgaatactaggtgtcggg<br>gccgtagaggcttcggtgccgcagcaaacgcagtaagtattccacctggggagtacgttcgcaagaatgaaactcaaaggaa<br>ttgacggggacccgcacaagcggtggagcatgtggtttaattcgaagcaacgcgaagaaccttacctggtcttgacatcccaa<br>tgaccgaaccttaaccggtttttctttcgagacattggagacaggtggtgcatggttgtcgtcagctcgtgtcgtgagatgttggg<br>ttaagtcccgcaacgagcgcaacccctatctttagtagccagcattacggatgggcactctagagagactgccagggataacct<br>ggaggaaggtggggacgacgtcaaatcatcatgccccttatggccagggctacacacgtgctacaatggcgtaaacaaagg<br>gaagcgaagtcgtgaggcgaagcaaatcccagaaataacgtctcagttcggattgtagtctgcaactcgactacatgaagctg<br>gaatcgctagtaatcgtgaatcagaatgtcacggtgaatacgttcccgggtcttgtacacaccgcccgtcacaccatgggagtc<br>agtaacgcccgaagtcagtgacccaaccgcaaggagggagctgccgaaggtgggaccgataactggggtgaagtcgtaac<br>aaggtagccgtatcggaaggtgcggctggatcacctccttt |
| *Anaerostipes_caccae* | SEQ ID NO: 63 | ctagcggtgaatgcgtagatattaggaggaacaccagtggcgaaggcggcttactggactgtcactgacactgatgcacgaa<br>agcgtggggagcaaacaggattagataccctggtagtccacgccgtaaacgatgaatactaggtgtcggggccgtagaggct<br>tcggtgccgcagcaaacgcagtaagtattccacctggggagtacgttcgcaagaatgaaactcaaaggaattgacggggacc<br>cgcacaagcggtggagcatgtggtttaattcgaagcaacgcgaagaaccttacctggtcttgacatcccaatgagcgaacctta<br>accggtttttctttcgagacattggagacaggtggtgcatggttgtcgtcagctcgtgtcgtgagatgttgggttaagtcccgcaa<br>cgagcgcaacccctatctttagtagccagcatttaaggtgggcactctagagagactgccagggataacctggaggaaggtg<br>gggacgacgtcaaatcatcatgccccttatggccagggctacacacgtgctacaatggcgtaaacaaagggaagcgaagtcg<br>tgaggcgaagcaaatcccagaaataacgtctcagttcggattgtagtctgcaactcgactacatgaagctggaatcgctagtaat<br>cgtgaatcagaatgtcacggtgaatacgttcccgggtcttgtacacaccgcccgtcacaccatgggagtcagtaacgcccgaa<br>gtcagtgacccaaccgcaaggagggagctgccgaaggtgggaccgataactggggtgaagtcgtaacaaggtagccgtat<br>cggaaggtgcggctggatcacctccttt |
| *Anaerostipes_caccae* | SEQ ID NO: 64 | atgagagtttgatcctggctcaggatgaacgctggcggcgtgcttaacacatgcaagtcgaacgaagcatttaggattgaagttt<br>tcggatggatttcctatatgactgagtggcggacgggtgagtaacgcgtggggaacctgccctatacagggggataacagctg<br>gaaacggctgctaataccgcataagcgcacagaatcgcatgattcagtgtgaaaagccctggcagtataggatggtcccgcgt<br>ctgattagctggttggtgaggtaacggctcaccaaggcgacgatcagtagccggcttgagagagtgaacggccacattggga<br>ctgagacacggcccaaactcctacgggaggcagcagtggggaatattgcacaatgggggaaaccctgatgcagcgacgcc<br>gcgtgagtgaagaagtatttcggtatgtaaagctctatcagcagggaagaaaacagacggtacctgactaagaagccccggct<br>aactacgtgccagcagccgcggtaatacgtagggggcaagcgttatccggaattactgggtgtaaagggtgcgtaggtggca<br>tggtaagtcagaagtgaaagcccggggcttaaccccgggactgcttttgaaactgtcatgctggagtgcaggagaggtaagc<br>ggaattcctagtgtagcggtgaaatgcgtagatattaggaggaacaccagtggcgaaggcggcttactggactgtcactgaca<br>ctgatgcacgaaagcgtggggagcaaacaggattagataccctggtagtccacgccgtaaacgatgaatactaggtgtcggg<br>gccgtagaggcttcggtgccgcagcaaacgcagtaagtattccacctggggagtacgttcgcaagaatgaaactcaaaggaa<br>ttgacggggacccgcacaagcggtggagcatgtggtttaattcgaagcaacgcgaagaaccttacctggtcttgacatcccaa<br>tgaccgaaccttaaccggtttttctttcgagacattggagacaggtggtgcatggttgtcgtcagctcgtgtcgtgagatgttggg<br>ttaagtcccgcaacgagcgcaacccctatctttagtagccagcatttaaggtgggcactctagagagactgccagggataacct<br>ggaggaaggtggggacgacgtcaaatcatcatgccccttatggccagggctacacacgtgctacaatggcgtaaacaaagg |

TABLE 5-continued

Full length 16S rDNA sequences of species (negative correlates)

| Species Name | Sequence Identifier | 16S rDNA sequence |
|---|---|---|
| | | gaagcgaagtcgtgaggcgaagcaaatcccagaaataacgtctcagttcggattgtagtctgcaactcgactacatgaagctg gaatcgctagtaatcgtgaatcagaatgtcacggtgaatacgttcccgggtcttgtacacaccgcccgtcacaccatgggagtc agtaacgcccgaagtcagtgacccaaccgcaan |
| *Anaerostipe s_caccae* | SEQ ID NO: 65 | atgagagtttgatcctggctcaggatgaacgctggcggcgtgcttaacacatgcaagtcgaacgaagcatttaggattgaagttt tcggatggatttcctatatgactgagtggcggacgggtgagtaacgcgtggggaacctgccctatacagggggataacagctg gaaacggctgctaataccgcataagcgcacagaatcgcatgattcagtgtgaaaagccctggcagtataggatggtcccgcgt ctgattagctggttggtgaggtaacggctcaccaaggcgacgatcagtagccggcttgagagagtgaacggccacattggga ctgagacacggcccaaactcctacgggaggcagcagtggggaatattgcacaatgggggaaaccctgatgcagcgacgcc gcgtgagtgaagaagtatttcggtatgtaaagctctatcagcagggaagaaaacagacggtacctgactaagaagccccggct aactacgtgccagcagccgcggtaatacgtagggggcaagcgttatccggaattactgggtgtaaagggtgcgtaggtggca tggtaagtcagaagtgaaagcccggggcttaaccccgggactgcttttgaaactgtcatgctggagtgcaggagaggtaagc ggaattcctagtgtagcggtgaaatgcgtagatattaggaggaacaccagtggcgaaggcggcttactggactgtcactgaca ctgatgcacgaaagcgtggggagcaaacaggattagataccctggtagtccacgccgtaaacgatgaatactaggtgtcggg gccgtagaggcttcggtgccgcagcaaacgcagtaagtattccacctggggagtacgttcgcaagaatgaaactcaaaggaa ttgacggggacccgcacaagcggtggagcatgtggtttaattcgaagcaacgcgaagaaccttacctggtcttgacatcccaa tgaccgaaccttaaccggtttttctttcgagacattggagacaggtggtgcatggttgtcgtcagctcgtgtcgtgagatgttggg ttaagtcccgcaacgagcgcaacccctatctttagtagccagcatttaaggtgggcactctagagagactgccagggataacct ggaggaaggtggggacgacgtcaaatcatcatgccccttatggccagggctacacacgtgctacaatggcgtaaacaaagg gaagcgaagtcgtgaggcgaagcaaatcccagaaataacgtctcagttcggattgtagtctgcaactcgactacatgaagctg gaatcgctagtaatcgtgaatcagaatgtcacggtgaatacgttcccgggtcttgtacacaccgcccgtcacaccatgggagtc agtaacgcccgaagtcagtgacccaaccgcaaggagggagctgccgaaggtgggaccgataactggggtgaagtcgtaac aaggtagccgtatcggaaggtgcggctggatcacctccttt |
| *Anaerostipe s_caccae* | SEQ ID NO: 66 | atgagagtttgatcctggctcaggatgaacgctggcggcgtgcttaacacatgcaagtcgaacgaagcatttaggattgaagttt tcggatggatttcctatatgactgagtggcggacgggtgagtaacgcgtggggaacctgccctatacagggggataacagct ggaaacggctgctaataccgcataagcgcacagaatcgcatgattcagtgtgaaaagccctggcagtataggatggtcccgc gtctgattagctggttggtgaggtaacggctcaccaaggcgacgatcagtagccggcttgagagagtgaacggccacattgg gactgagacacggcccaaactcctacgggaggcagcagtggggaatattgcacaatgggggaaaccctgatgcagcgacg ccgcgtgagtgaagaagtatttcggtatgtaaagctctatcagcagggaagaaaacagacggtacctgactaagaagccccg gctaactacgtgccagcagccgcggtaatacgtagggggcaagcgttatccggaattactgggtgtaaagggtgcgtaggtg gcatggtaagtcagaagtgaaagcccggggcttaaccccgggactgcttttgaaactgtcatgctggagtgcaggagaggta agcggaattcctagtgtagcggtgaaatgcgtagatattaggaggaacaccagtggcgaaggcggcttactggactgtcactg acactgatgcacgaaagcgtggggagcaaacaggattagataccctggtagtccacgccgtaaacgatgaatactaggtgtc ggggccgtagaggcttcggtgccgcagcaaacgcagtaagtattccacctggggagtacgttcgcaagaatgaaactcaaag gaattgacggggacccgcacaagcggtggagcatgtggtttaattcgaagcaacgcgaagaaccttacctggtcttgacatcc caatgagcgaaccttaaccggtttttctttcgagacattggagacaggtggtgcatggttgtcgtcagctcgtgtcgtgagatgtt gggttaagtcccgcaacgagcgcaacccctatctttagtagccagcatttaaggtgggcactctagagagactgccagggata acctggaggaaggtggggacgacgtcaaatcatcatgccccttatggccagggctacacacgtgctacaatggcgtaaacaa agggaagcgaagtcgtgaggcgaagcaaatcccagaaataacgtctcagttcggattgtagtctgcaactcgactacatgaag ctggaatcgctagtaatcgtgaatcagaatgtcacggtgaatacgttcccgggtcttgtacacaccgcccgtcacaccatggga gtcagtaacgcccgaagtcagtgacccaaccgcaaggagggagctgccgaaggtgggaccgataactggggtgaagtcgt aacaaggtagccgtatcggaaggtgcggctggatcacctccttt |
| *Eubacterium _siraeum* | SEQ ID NO: 67 | caaagagtttgatcctggctcaggacgaacgctggcggcgcgcctaacacatgcaagtcgaacggtgaagaggagcttgctc ctcggatcagtggcggacgggtgagtaacacgtgagcaacctggctctaagaggggacaacagttggaaacgactgctaa taccgcataacgtatcgggatggcatcttcctgataccaaagattttatcgcttagagatgggctcgcgtctgattagatagttggc ggggtaacggcccaccaagtcgacgatcagtagccggactgagaggttgaacggccacattgggactgagacacggccca |

TABLE 5-continued

Full length 16S rDNA sequences of species (negative correlates)

| Species Name | Sequence Identifier | 16S rDNA sequence |
|---|---|---|
| | | gactcctacgggaggcagcagtggggaatattggacaatgggggcaaccctgatccagcgacgccgcgtgagggaagaa<br>ggttttcggattgtaaacctctgttgacggagaaaaaaatgatggtatccgtttagaaagccacggctaactacgtgccagcagc<br>cgcggtaatacgtaggtggcaagcgttgtccggaattactgggtgtaaagggagtgtaggcgggatatcaagtcagaagtga<br>aaattacgggctcaactcgtaacctgcttttgaaactgacattcttgagtgaagtagaggcaagcggaattcctagtgtagcggt<br>gaaatgcgtagatattaggaggaacaccagtggcgaaggcggcttgctgggcttttactgacgctgaggctcgaaagcgtgg<br>ggagcaaacaggattagataccctggtagtccacgccgtaaacgatgattactaggtgtgggggggattgaccccttccgtgcc<br>ggagtaaacacaataagtaatccacctggggagtacgaccgcaaggttgaaactcaaaggaattgacgggggcccgcacaa<br>gcagtggagtatgtggtttaattcgacgcaacgcgaagaaccttaccaggtcttgacatcgagtgaccgcctaagagattaggc<br>tttcccttcggggacacaaagacaggtggtgcatggttgtcgtcagctcgtgtcgtgagatgttgggttaagtcccgcaacgag<br>cgcaacccttatcattagttgctacgcaagagcactctaatgagactgccgttgacaaaacggaggaaggtggggatgacgtc<br>aaatcatcatgccctttatgacctgggctacacacgtactacaatggcgtttaacaaagagaagcaaagccgcgaggcagagc<br>aaatctccaaaaaaacgtctcagttcggattgtaggctgcaactcgcctacatgaagtcggaattgctagtaatcgtaggtcagca<br>tactacggtgaatacgttcccgggccttgtacacaccgcccgtcaaaccatgagagttggcaacacccgaagtcggtagtctaa<br>ccgcaaggaggacgccgccgaaggtggggttgatgattagggttaagtcgtaacaaggtagccgtatcggaaggtgcggct<br>ggatcacctccttt |
| *Eubacterium _siraeum* | SEQ ID NO: 68 | caaagagtttgatcctggctcaggacgaacgctggcggcgcgcctaacacatgcaagtcgaacggtgaagaggagcttgctc<br>ctcggaacagtggcggacgggtgagtaacacgtgagcaacctggctctaagagggggacaacagttggaaacgactgctaa<br>taccgcataacgtatcgggatggcatcttcctgataccaaagattttatcgcttagagatgggctcgcgtctgattagatagttggc<br>ggggtaacggcccaccaagtcgacgatcagtagccggactgagaggttgaacggccacattgggactgagacacggccca<br>gactcctacgggaggcagcagtggggaatattggacaatgggggcaaccctgatccagcgacgccgcgtgagggaagaa<br>ggttttcggattgtaaacctctgttgacggagaaaaaaatgatggtatccgtttagaaagccacggctaactacgtgccagcagc<br>cgcggtaatacgtaggtggcaagcgttgtccggaattactgggtgtaaagggagtgtaggcgggatatcaagtcagaagtga<br>aaattacgggctcaactcgtaacctgcttttgaaactgacattcttgagtgaagtagaggcaagcggaattcctagtgtagcggt<br>gaaatgcgtagatattaggaggaacaccagtggcgaaggcggcttgctgggcttttactgacgctgaggctcgaaagcgtgg<br>ggagcaaacaggattagataccctggtagtccacgccgtaaacgatgattactaggtgtgggggggattgaccccttccgtgcc<br>ggagtaaacacaataagtaatccacctggggagtacgaccgcaaggttgaaactcaaaggaattgacgggggcccgcacaa<br>gcagtggagtatgtggtttaattcgacgcaacgcgaagaaccttaccaggtcttgacatcgagtgaccgcctaagagattaggc<br>tttcccttcggggacacaaagacaggtggtgcatggttgtcgtcagctcgtgtcgtgagatgttgggttaagtcccgcaacgag<br>cgcaacccttatcattagttgctacgcaagagcactctaatgagactgccgttgacaaaacggaggaaggtggggatgacgtc<br>aaatcatcatgccctttatgacctgggctacacacgtactacaatggcgtttaacaaagagaagcaaagccgcgaggcagagc<br>aaatctccaaaaaaacgtctcagttcggattgtaggctgcaactcgcctacatgaagtcggaattgctagtaatcgtaggtcagca<br>tactacggtgaatacgttcccgggccttgtacacaccgcccgtcaaaccatgagagttggcaacacccgaagtcggtagtctaa<br>ccgcaaggaggacgccgccgaaggtggggttgatgattagggttaagtcgtaacaaggtagccgtatcggaaggtgcggct<br>ggatcacctccttt |
| *Eubacterium _siraeum* | SEQ ID NO: 69 | caaagagtttgatcctggctcaggacgaacgctggcggcgcgcctaacacatgcaagtcgaacggtgaagaggagcttgctc<br>ctcggatcagtggcggacgggtgagtaacacgtgagcaacctggctctaagagggggacaacagttggaaacgactgctaa<br>taccgcatgatgtatcgggatggcatcttcctgataccaaagattttatcgcttagagatgggctcgcgtctgattagatagttggc<br>ggggtaacggcccaccaagtcgacgatcagtagccggactgagaggttgaacggccacattgggactgagacacggccca<br>gactcctacgggaggcagcagtggggaatattggacaatgggggcaaccctgatccagcgacgccgcgtgagggaagaa<br>ggttttcggattgtaaacctctgttgacggagaaaaaaatgatggtatccgtttagaaagccacggctaactacgtgccagcagc<br>cgcggtaatacgtaggtggcaagcgttgtccggaattactgggtgtaaagggagtgtaggcgggatatcaagtcagaagtga<br>aaattacgggctcaactcgtaacctgcttttgaaactgacattcttgagtgaagtagaggcaagcggaattcctagtgtagcggt<br>gaaatgcgtagatattaggaggaacaccagtggcgaaggcggcttgctgggcttttactgacgctgaggctcgaaagcgtgg<br>ggagcaaacaggattagataccctggtagtccacgccgtaaacgatgattactaggtgtgggggggattgaccccttccgtgcc<br>ggagtaaacacaataagtaatccacctggggagtacgaccgcaaggttgaaactcaaaggaattgacgggggcccgcacaa<br>gcagtggagtatgtggtttaattcgacgcaacgcgaagaaccttaccaggtcttgacatcgagtgaccgcctaagagattaggc |

TABLE 5-continued

| Full length 16S rDNA sequences of species (negative correlates) | | |
|---|---|---|
| Species Name | Sequence Identifier | 16S rDNA sequence |
| | | tttcccttcggggacacaaagacaggtggtgcatggttgtcgtcagctcgtgtcgtgagatgttgggttaagtcccgcaacgag<br>cgcaacccttatcattagttgctacgcaagagcactctaatgagactgccgttgacaaaacggaggaaggtggggatgacgtc<br>aaatcatcatgccctttatgacctgggctacacacgtactacaatggcgtttaacaaagagaagcaaagccgcgaggcagagc<br>aaatctccaaaaaacgtctcagttcggattgtaggctgcaactcgcctacatgaagtcggaattgctagtaatcgtaggtcagca<br>tactacggtgaatacgttcccgggccttgtacacaccgcccgtcaaaccatgagagttggcaacacccgaagtcggtagtctaa<br>ccgcaaggaggacgccgccgaaggtggggttgatgattagggttaagtcgtaacaaggtagccgtatcggaaggtgcggct<br>ggatcacctcctttt |
| *Eubacterium _siraeum* | SEQ ID NO: 70 | caaagagtttgatcctggctcaggacgaacgctggcggcgcgcctaacacatgcaagtcgaacggtgaagaggagcttgctc<br>ctcggatcagtggcggacgggtgagtaacacgtgagcaacctggctctaagagggggacaacagttggaaacgactgctaa<br>taccgcataacgtatcgggatggcatcttcctgataccaaagattttatcgcttagagatgggctcgcgtctgattagatagttggc<br>ggggtaacggcccaccaagtcgacgatcagtagccggactgagaggttgaacggccacattgggactgagacacggccca<br>gactcctacgggaggcagcagtgggggatattggacaatgggggcaaccctgatccagcgacgccgcgtgagggaagaa<br>ggttttcggattgtaaacctctgttgacggagaaaaaaatgatggtatccgtttagaaagccacggctaactacgtgccagcagc<br>cgcggtaatacgtaggtggcaagcgttgtccggaattactgggtgtaaagggagtgtaggcgggatatcaagtcagaagtga<br>aaattacgggctcaactcgtaacctgcttttgaaactgacattcttgagtgaagtagaggcaagcggaattcctagtgtagcggt<br>gaaatgcgtagatattaggaggaacaccagtggcgaaggcggcttgctgggcttttactgacgctgaggctcgaaagcgtgg<br>ggagcaaacaggattagataccctggtagtccacgccgtaaacgatgattactaggtgtgggggggattgaccccttccgtgcc<br>ggagtaaacacaataagtaatccacctggggagtacgaccgcaaggttgaaactcaaaggaattgacgggggcccgcacaa<br>gcagtggagtatgtggtttaattcgacgcaacgcgaagaaccttaccaggtcttgacatcgagtgaccgcctaagagattaggc<br>cttcccttcggggacacaaagacaggtggtgcatggttgtcgtcagctcgtgtcgtgagatgttgggttaagtcccgcaacgag<br>cgcaacccttatcattagttgctacgcaagagcactctaatgagactgccgttgacaaaacggaggaaggtggggatgacgtc<br>aaatcatcatgccctttatgacctgggctacacacgtactacaatggcgtttaacaaagagaagcaaagccgcgaggcagagc<br>aaatctccaaaaaacgtctcagttcggattgtaggctgcaactcgcctacatgaagtcggaattgctagtaatcgtaggtcagca<br>tactacggtgaatacgttcccgggccttgtacacaccgcccgtcaaaccatgagagttggcaacacccgaagtcggtagtctaa<br>ccgcaaggaggacgccgccgaaggtggggttgatgattagggttaagtcgtaacaaggtagccgtatcggaaggtgcggct<br>ggatcacctcctttt |
| *Clostridium _leptum* | SEQ ID NO: 71 | tttagagagtttgatcctggctcaggacgaacgctggcggcgtgcctaacacatgcaagtcgaacggagttaaattcgacacc<br>cgagtatccggccgggaggcggggtgctgggggttggatttaacttagtggcggacgggtgagtaacgcgtgagtaacctg<br>cctttcagagggggataacgttctgaaaagaacgctaataccgcataacatcaatttatcgcatgataggttgatcaaaggagca<br>atccgctggaagatggactcgcgtccgattagccagttggcggggtaacggcccaccaaagcgacgatcggtagccggact<br>gagaggttgaacggccacattgggactgagacacggcccagactcctacgggaggcagcagtgggggatattgcacaatg<br>ggggaaaccctgatgcagcaacgccgcgtgagggaagaaggttttcggattgtaaacctctgttcttagtgacgataatgacg<br>gtagctaaggagaaagctccggctaactacgtgccagcagccgcggtaatacgtagggagcgagcgttgtccggatttactg<br>ggtgtaaagggtgcgtaggcggcgaggcaagtcaggcgtgaaatctatgggcttaacccataaactgcgcttgaaactgtctt<br>gcttgagtgaagtagaggtaggcggaattcccggtgtagcggtgaaatgcgtagagatcgggaggaacaccagtggcgaag<br>gcggcctactgggctttaactgacgctgaagcacgaaagcatgggtagcaaacaggattagataccctggtagtccatgccgt<br>aaacgatgattactaggtgtgggggggtctgacccccctccgtgccgcagttaacacaataagtaatccacctggggagtacggc<br>cgcaaggttgaaactcaaaggaattgacgggggcccgcacaagcagtggagtatgtggtttaattcgaagcaacgcgaagaa<br>ccttaccaggtcttgacatccgtctaacgaagcagagatgcattaggtgcccttcggggaaaggcgagacaggtggtgcatgg<br>ttgtcgtcagctcgtgtcgtgagatgttgggttaagtcccgcaacgagcgcaacccttgtttctagttgctacgcaagagcactct<br>agagagactgccgttgacaaaacggaggaaggtggggacgacgtcaaatcatcatgccccttatgacctgggccacacacgt<br>actacaatggctgtaaacagagggaagcaaagccgcgaggtggagcaaaaccctaaaagcagtcccagttcggatcgcag<br>gctgcaacccgcctgcgtgaagtcggaattgctagtaatcgcggatcagcatgccgcggtgaatacgttcccgggccttgtac<br>acaccgcccgtcacaccatgggagccggtaatacccgaagccagtagttcaaccgcaaggagagcgctgtcgaaggtagg<br>attggcgactggggtgaagtcgtaacaaggtagccgtatcggaaggtgcggaggatcacctcctttt |

TABLE 5-continued

Full length 16S rDNA sequences of species (negative correlates)

| Species Name | Sequence Identifier | 16S rDNA sequence |
|---|---|---|
| *Clostridium _Leptum* | SEQ ID NO: 72 | tttagagagtttgatcctggctcaggacgaacgctggcggcgtgcctaacacatgcaagtcgaacggagttaaattcgacacc<br>cgagtatccggccgggaggcggggtgctggggggttggatttaacttagtggcggacgggtgagtaacgcgtgagtaacctg<br>cctttcagaggggggataacgttctgaaaagaacgctaataccgcataacatcaatttatcgcatgataggttgatcaaaggagca<br>atccgctggaagatggactcgcgtccgattagccagttggcggggtaacggcccaccaaagcgacgatcggtagccggact<br>gagaggttgaacggccacattgggactgagacacggcccagactcctacgggaggcagcagtgggggatattgcacaatg<br>ggggaaaccctgatgcagcaacgccgcgtgagggaagaaggttttcggattgtaaacctctgttcttagtgacgataatgacg<br>gtagctaaggagaaagctccggctaactacgtgccagcagccgcggtaatacgtagggagcgagcgttgtccggatttactg<br>ggtgtaaagggtgcgtaggcggcgaggcaagtcaggcgtgaaatctatgggcttaacccataaactgcgcttgaaactgtctt<br>gcttgagtgaagtagaggtaggcggaattcccggtgtagcggtgaaatgcgtagagatcgggaggaacaccagtggcgaag<br>gcggcctactgggctttaactgacgctgaagcacgaaagcatgggtagcaaacaggattagataccctggtagtccatgccgt<br>aaacgatgattactaggtgtgggggggtctgacccctccgtgccgcagttaacacaataagtaatccacctggggagtacggc<br>cgcaaggttgaaactcaaaggaattgacgggggcccgcacaagcagtggagtatgtggtttaattcgaagcaacgcgaagaa<br>ccttaccaggtcttgacatccgtctaacgaagcagagatgcattaggtgcccttcggggaaaggcgagacaggtggtgcatgg<br>ttgtcgtcagctcgtgtcgtgagatgttgggttaagtcccgcaacgagcgcaacccttgtttctagttgctacgcaagagcactct<br>agagagactgccgttgacaaaacggaggaaggtggggacgacgtcaaatcatcatgccccttatgacctgggccacacacgt<br>actacaatggctgtaaacagagggaagcaaagccgcgaggtggagcaaaaccctaaaagcagtcccagttcggatcgcag<br>gctgcaacccgcctgcgtgaagtcggaattgctagtaatcgcggatcagcatgccgcggtgaatacgttcccgggccttgtac<br>acaccgcccgtcacaccatgggagccggtaatacccgaagccagtagttcaaccgcaaggagagcgctgtcgaaggtagg<br>attggcgactggggtgaagtcgtaacaaggtagccgtatcggaaggtgcggaggatcacctccttt |
| *Clostridium _boltcae* | SEQ ID NO: 73 | atgagagtttgatcctggctcaggatgaacgctggcggcgtgcctaacacatgcaagtcgaacgaagcaattgaaggaagtttt<br>cggatggaattcgattgactgagtggcggacgggtgagtaacgcgtggataacctgcctcacactgggggataacagttaga<br>aatgactgctaataccgcataagcgcacagtaccgcatggtacagtgtgaaaaactccggtggtgtgagatggatccgcgtct<br>gattagccagaggcggggtaacggcccaccaaagcgacgatcagtagccgacctgagagggtgaccggccacattggga<br>ctgagacacggcccaaactcctacgggaggcagcagtggggaatattgcacaatgggcgaaagcctgatgcagcgacgcc<br>gcgtgagtgaagaagtatttcggtatgtaaagctctatcagcagggaagaaaatgacggtacctgactaagaagccccggcta<br>actacgtgccagcagccgcggtaatacgtagggggcaagcgttatccggatttactgggtgtaaagggagcgtagacggcg<br>aagcaagtctgaagtgaaaacccagggctcaaccctgggactgctttggaaactgttttgctagagtgtcggagaggtaagtg<br>gaattcctagtgtagcggtgaaatgcgtagatattaggaggaacaccagtggcgaaggcggcttactggacgataactgacgt<br>tgaggctcgaaagcgtggggagcaaacaggattagataccctggtagtccacgccgtaaacgatgaatgctaggtgttgggg<br>ggcaaagcccttcggtgccgtcgcaaacgcagtaagcattccacctggggagtacgttcgcaagaatgaaactcaaaggaatt<br>gacggggacccgcacaagcggtggagcatgtggtttaattcgaagcaacgcgaagaaccttaccaagtcttgacatcctcttg<br>accggcgtgtaacggcgccttcccttcggggcaagagagacaggtggtgcatggttgtcgtcagctcgtgtcgtgagatgttg<br>ggttaagtcccgcaacgagcgcaacccttatccttagtagccagcaggtaaagctgggcactctagggagactgccagggat<br>aacctggaggaaggtggggatgacgtcaaatcatcatgccccttatgatttgggctacacacgtgctacaatggcgtaaacaaa<br>gggaagcaagacagtgatgtggagcaaatcccaaaaataacgtcccagttcggactgtagtctgcaacccgactacacgaag<br>ctggaatcgctagtaatcgcgaatcagaatgtcgcggtgaatacgttcccgggtcttgtacacaccgcccgtcacaccatggga<br>gtcagcaacgcccgaagtcagtgacccaactcgcaagagagggagctgccgaaggcggggcaggtaactggggtgaagt<br>cgtaacaaggtagccgtatcggaaggtgcggctggatcacctccttt |
| *Faecalibacte rium_prausn itzii* | SEQ ID NO: 74 | tataaagagtttgatcctggctcaggacgaacgctggcggcgcgcctaacacatgcaagtcgaacgagcgagagagagcttg<br>ctttcttgagcgagtggcgaacgggtgagtaacgcgtgaggaacctgcctcaaagagggggacaacagttggaaacgactg<br>ctaataccgcataagcccacggctcggcatcgagcagagggaaaaggagcaatccgctttgagatggcctcgcgtccgatta<br>gctggttggtgaggtaacggcccaccaaggcgacgatcggtagccggactgagaggttgaacggccacattgggactgaga<br>cacggcccagactcctacgggaggcagcagtggggaatattgcacaatgggggaaaccctgatgcagcgacgccgcgtgg<br>aggaagaaggtcttcggattgtaaactcctgagttgaggaagataatgacggtactcaacaaggaagtgacggctaactacgt<br>gccagcagccgcggtaaaacgtaggtcacaagcgttgtccggaattactgggtgtaaagggagcgcaggcgggaagacaa<br>gttggaagtgaaatccatgggctcaacccatgaactgctttcaaaactgtttttcttgagtagtgcagaggtaggcggaattcccg |

TABLE 5-continued

Full length 16S rDNA sequences of species (negative correlates)

| Species Name | Sequence Identifier | 16S rDNA sequence |
|---|---|---|
| | | gtgtagcggtggaatgcgtagatatcgggaggaacaccagtggcgaaggcggcctactgggcaccaactgacgctgaggct<br>cgaaagtgtgggtagcaaacaggattagataccctggtagtccae actgtaaacgatgattactaggtgttggaggattgaccc<br>cttcagtgccgcagttaacacaataagtaatccacctggggagtacgaccgcaaggttgaaactcaaaggaattgacgggg<br>cccgcacaagcagtggagtatgtggtttaattcgacgcaacgcgaagaaccttaccaagtcttgacatcccttgacgatgctgg<br>aaacagtatttctcttcggagcaaggagacaggtggtgcatggttgtcgtcagctcgtgtcgtgagatgttgggttaagtcccgc<br>aacgagcgcaacccttatggtcagttactacgcaagaggactctggccagactgccgttgacaaaacggaggaaggtgggg<br>atgacgtcaaatcatcatgccctttatgacttgggctacacacgtactacaatggcgttaaacaaagagaagcaagaccgcgag<br>gtggagcaaaactcagaaacaacgtcccagttcggactgcaggctgcaactcgcctgcacgaagtcggaattgctagtaatcg<br>cagatcagcatgctgcggtgaatacgttcccgggccttgtacacaccgcccgtcacaccatgagagccgggggacccgaa<br>gtcggtagtctaaccgcaaggaggacgccgccgaaggtaaaactggtgattggggtgaagtcgtaacaaggtagccgtagg<br>agaacctgcggctggatcacctccttt |
| *Faecalibacterium_prausnitzii* | SEQ ID NO: 75 | tataaagagtttgatcctggctcaggacgaacgctggcggcgcgcctaacacatgcaagtcgaacgagcgagaggaggttta<br>ctttctcaagcgagtggcgaacgggtgagtaacgcgtgaggaacctgcctcaaagagggggacaacagttggaaacgactg<br>ctaataccgcataagcccacgacccggcatcgggtagagggaaaaggagcaatccgctttgagatggcctcgcgtccgatta<br>gctagttggtgaggtaatggcccaccaaggcgacgatcggtagccggactgagaggttgaacggccacattgggactgaga<br>cacggcccagactcctacgggaggcagcagtggggaatattgcacaatgggggaaaccctgatgcagcgacgccgcgtgg<br>aggaagaaggtcttcggattgtaaactcctgttgttgaggaagataatgacggtactcaacaaggaagtgacggctaactacgt<br>gccagcagccgcggtaaaacgtaggtcacaagcgttgtccggaattactgggtgtaaagggagcgcaggcgggaagacaa<br>gttggaagtgaaatccatgggctcaacccatgaactgctttcaaaactgtttttcttgagtagtgcagaggtaggcggaattcccg<br>gtgtagcggtggaatgcgtagatatcgggaggaacaccagtggcgaaggcggcctactgggcaccaactgacgctgaggct<br>cgaaagtgtgggtagcaaacaggattagataccctggtagtccacactgtaaacgatgattactaggtgttggaggattgaccc<br>cttcagtgccgcagttaacacaataagtaatccacctggggagtacgaccgcaaggttgaaactcaaaggaattgacgggg<br>cccgcacaagcagtggagtatgtggtttaattcgacgcaacgcgaagaaccttaccaagtcttgacatcctgcgacgcacatag<br>aaatatgtgtttccttcgggacgcagagacaggtggtgcatggttgtcgtcagctcgtgtcgtgagatgttgggttaagtcccgc<br>aacgagcgcaacccttatggtcagttactacgcaagaggactctggccagactgccgttgacaaaacggaggaaggtgggg<br>atgacgtcaaatcatcatgccctttatgacttgggctacacacgtactacaatggcgttaaacaaagagaagcaagaccgcgag<br>gtggagcaaaactcagaaacaacgtcccagttcggactgcaggctgcaactcgcctgcacgaagtcggaattgctagtaatcg<br>cagatcagcatgctgcggtgaatacgttcccgggccttgtacacaccgcccgtcacaccatgagagccgggggacccgaa<br>gtcggtagtctaaccgcaaggaggacgccgccgaaggtaaaactggtgattggggtgaagtcgtaacaaggtagccgtagg<br>agaacctgcggctggatcacctccttt |
| *Faecalibacterium_prausnitzii* | SEQ ID NO: 76 | tataaagagtttgatcctggctcaggacgaacgctggcggcgcgcctaacacatgcaagtcgaacgagcgagagagagcttg<br>ctttctcaagcgagtggcgaacgggtgagtaacgcgtgaggaacctgcctcaaagagggggacaacagttggaaacgactg<br>ctaataccgcataagcccacgacccggcatcgggtagagggaaaaggagcaatccgctttgagatggcctcgcgtccgatta<br>gctagttggtgaggtaacggcccaccaaggcgacgatcggtagccggactgagaggttgaacggccacattgggactgaga<br>cacggcccagactcctacgggaggcagcagtggggaatattgcacaatgggggaaaccctgatgcagcgacgccgcgtgg<br>aggaagaaggtcttcggattgtaaactcctgttgttgaggaagataatgacggtactcaacaaggaagtgacggctaactacgt<br>gccagcagccgcggtaaaacgtaggtcacaagcgttgtccggaattactgggtgtaaagggagcgcaggcgggaagacaa<br>gttggaagtgaaatccatgggctcaacccatgaactgctttcaaaactgtttttcttgagtagtgcagaggtaggcggaattcccg<br>gtgtagcggtggaatgcgtagatatcgggaggaacaccagtggcgaaggcggcctactgggcaccaactgacgctgaggct<br>cgaaagtgtgggtagcaaacaggattagataccctggtagtccacaccgtaaacgatgattactaggtgttggaggattgaccc<br>cttcagtgccgcagttaacacaataagtaatccacctggggagtacgaccgcaaggttgaaactcaaaggaattgacgggg<br>cccgcacaagcagtggagtatgtggtttaattcgacgcaacgcgaagaaccttaccaagtcttgacatcccttgacgatgctgg<br>aaacagtatttctcttcggagcaaggagacaggtggtgcatggttgtcgtcagctcgtgtcgtgagatgttgggttaagtcccgc<br>aacgagcgcaacccttatggtcagttactacgcaagaggactctggccagactgccgttgacaaaacggaggaaggtgggg<br>atgacgtcaaatcatcatgccctttatgacttgggctacacacgtactacaatggcgttaaacaaagagaagcaagaccgcgag<br>gtggagcaaaactcagaaacaacgtcccagttcggactgcaggctgcaactcgcctgcacgaagtcggaattgctagtaatcg |

TABLE 5-continued

Full length 16S rDNA sequences of species (negative correlates)

| Species Name | Sequence Identifier | 16S rDNA sequence |
|---|---|---|
| | | cagatcagcatgctgcggtgaatacgttcccgggccttgtacacaccgcccgtcacaccatgagagccgggggacccgaa gtcggtagtctaaccgcaaggaggacgccgccgaaggtaaaactggtgattggggtgaagtcgtaacaaggtagccgtagg agaacctgcggctggatcacctccttt |
| *Faecalibacterium_prausnitzii* | SEQ ID NO: 77 | tataaagagtttgatcctggctcaggacgaacgctggcggcgcgcctaacacatgcaagtcgaacgagcgagagagagcttg ctttctcaagcgagtggcgaacgggtgagtaacgcgtgaggaacctgcctcaaagagggggacaacagttggaaacgactg ctaataccgcataagcccacgacccggcatcgggtagagggaaaaggagcaatccgctttgagatggcctcgcgtccgatta gctggttggtgaggtaacggcccaccaaggcgacgatcggtagccggactgagaggttgaacggccacattgggactgaga cacggcccagactcctacgggaggcagcagtggggaatattgcacaatgggggaaaccctgatgcagcgacgccgcgtgg aggaagaaggtcttcggattgtaaactcctgttgttgaggaagataatgacggtactcaacaaggaagtgacggctaactacgt gccagcagccgcggtaaaacgtaggtcacaagcgttgtccggaattactgggtgtaaagggagcgcaggcgggaagacaa gttggaagtgaaatccatgggctcaacccatgaactgctttcaaaactgtttttcttgagtagtgcagaggtaggcggaattcccg gtgtagcggtggaatgcgtagatatcgggaggaacaccagtggcgaaggcggcctactgggcaccaactgacgctgaggct cgaaagtgtgggtagcaaacaggattagataccctggtagtccacaccgtaaacgatgattactaggtgttggaggattgaccc cttcagtgccgcagttaacacaataagtaatccacctggggagtacgaccgcaaggttgaaactcaaaggaattgacgggg cccgcacaagcagtggagtatgtggtttaattcgacgcaacgcgaagaaccttaccaagtcttgacatcctgcgacgcacatag aaatatgtgtttccttcgggacgcagagacaggtggtgcatggttgtcgtcagctcgtgtcgtgagatgttgggttaagtcccgc aacgagcgcaacccttatggtcagttactacgcaagaggactctggccagactgccgttgacaaaacggaggaaggtgggg atgacgtcaaatcatcatgccctttatgacttgggctacacacgtactacaatggcgttaaacaaagagaagcaagaccgcgag gtggagcaaaactcagaaacaacgtcccagttcggactgcaggctgcaactcgcctgcacgaagtcggaattgctagtaatcg cagatcagcatgctgcggtgaatacgttcccgggccttgtacacaccgcccgtcacaccatgagagccgggggacccgaa gtcggtagtctaaccgcaaggaggacgccgccgaaggtaaaactggtgattggggtgaagtcgtaacaaggtagccgtagg agaacctgcggctggatcacctccttt |
| *Faecalibacterium_prausnitzii* | SEQ ID NO: 78 | tataaagagtttgatcctggctcaggacgaacgctggcggcgcgcctaacacatgcaagtcgaacgagcgagagagagcttg ctttctcaagcgagtggcgaacgggtgagtaacgcgtgaggaacctgcctcaaagagggggacaacagttggaaacgactg ctaataccgcataagcccacgacccggcatcgggtagagggaaaaggagcaatccgctttgagatggcctcgcgtccgatta gctagttggtgaggtaacggcccaccaaggcgacgatcggtagccggactgagaggttgaacggccacattgggactgaga cacggcccagactcctacgggaggcagcagtggggaatattgcacaatgggggaaaccctgatgcagcgacgccgcgtgg aggaagaaggtcttcggattgtaaactcctgttgttgaggaagataatgacggtactcaacaaggaagtgacggctaactacgt gccagcagccgcggtaaaacgtaggtcacaagcgttgtccggaattactgggtgtaaagggagcgcaggcgggaagacaa gaggaagtgaaatccatgggctcaacccatgaactgctttcaaaactgtttttcttgagtagtgcagaggtaggcggaattcccg gtgtagcggtggaatgcgtagatatcgggaggaacaccagtggcgaaggcggcctactgggcaccaactgacgctgaggct cgaaagtgtgggtagcaaacaggattagataccctggtagtccacactgtaaacgatgattactaggtgttggaggattgaccc cttcagtgccgcagttaacacaataagtaatccacctggggagtacgaccgcaaggttgaaactcaaaggaattgacgggg cccgcacaagcagtggagtatgtggtttaattcgacgcaacgcgaagaaccttaccaagtcttgacatcctgcgacgcacatag aaatatgtgtttccttcgggacgcagagacaggtggtgcatggttgtcgtcagctcgtgtcgtgagatgttgggttaagtcccgc aacgagcgcaacccttatggtcagttactacgcaagaggactctggccagactgccgttgacaaaacggaggaaggtgggg atgacgtcaaatcatcatgccctttatgacttgggctacacacgtactacaatggcgttaaacaaagagaagcaagaccgcgag gtggagcaaaactcagaaacaacgtcccagttcggactgcaggctgcaactcgcctgcacgaagtcggaattgctagtaatcg cagatcagcatgctgcggtgaatacgttcccgggccttgtacacaccgcccgtcacaccatgagagccgggggacccgaa gtcggtagtctaaccgcaaggaggacgccgccgaaggtaaaactggtgattggggtgaagtcgtaacaaggtagccgtagg agaacctgcggctggatcacctccttt |
| *Faecalibacterium_prausnitzii* | SEQ ID NO: 79 | tataaagagtttgatcctggctcaggacgaacgctggcggcgcgcctaacacatgcaagtcgaacgagcgagagagagcttg ctttctcaagcgagtggcgaacgggtgagtaacgcgtgaggaacctgcctcaaagagggggacaacagttggaaacgactg ctaataccgcataagcccacgacccggcatcgggtagagggaaaaggagcaatccgctttgagatggcctcgcgtccgatta gctagttggtgaggtaatggcccaccaaggcgacgatcggtagccggactgagaggttgaacggccacattgggactgaga |

TABLE 5-continued

Full length 16S rDNA sequences of species (negative correlates)

| Species Name | Sequence Identifier | 16S rDNA sequence |
|---|---|---|
| | | cacggcccagactcctacgggaggcagcagtggggaatattgcacaatggggaaaccctgatgcagcgacgccgcgtgg<br>aggaagaaggtcttcggattgtaaactcctgttgttgaggaagataatgacggtactcaacaaggaagtgacggctaactacgt<br>gccagcagccgcggtaaaacgtaggtcacaagcgttgtccggaattattgggtgtaaagggagcgcaggcgggaagacaa<br>gttggaagtgaaatccatgggctcaacccatgaactgctttcaaaactgtttttcttgagtagtgcagaggtaggcggaattcccg<br>gtgtagcggtggaatgcgtagatatcgggaggaacaccagtggcgaaggcggcctactgggcaccaactgacgctgaggct<br>cgaaagtgtgggtagcaaacaggattagataccctggtagtccacactgtaaacgatgattactaggtgttggaggattgaccc<br>cttcagtgccgcagttaacacaataagtaatccacctggggagtacgaccgcaaggttgaaactcaaaggaattgacggggg<br>cccgcacaagcagtggagtatgtggtttaattcgacgcaacgcgaagaaccttaccaagtcttgacatcctgcgacgcacatag<br>aaatatgtgtttccttcgggacgcagagacaggtggtgcatggttgtcgtcagctcgtgtcgtgagatgttgggttaagtcccgc<br>aacgagcgcaacccttatggtcagttactacgcaagaggactctggccagactgccgttgacaaaacggaggaaggtgggg<br>atgacgtcaaatcatcatgccctttatgacttgggctacacacgtactacaatggcgttaaacaaagagaagcaagaccgcgag<br>gtggagcaaaactcagaaacaacgtcccagttcggactgcaggctgcaactcgcctgcacgaagtcggaattgctagtaatcg<br>cagatcagcatgctgcggtgaatacgttcccgggccttgtacacaccgcccgtcacaccatgagagccgggggggacccgaa<br>gtcggtagtctaaccgcaaggaggacgccgccgaaggtaaaactggtgattggggtgaagtcgtaacaaggtagccgtagg<br>agaacctgcggctggatcacctccttt |
| *Clostridium* *_bartlettii* | SEQ ID NO: 80 | atttgagagtttgatcctggctcaggatgaacgaggcggcgtgcctaacacatgcaagtcgagcgattctcttcggagaagag<br>cggcggacgggtgagtaacgcgtgggtaacctgccctgtacacacggataacataccgaaaggtatgctaatacgggataac<br>ataagaaattcgcatgtttttcttatcaaagctccggcggtacaggatggacccgcgtctgattagctagttggtgaggtaacggc<br>tcaccaaggcgacgatcagtagccgacctgagagggtgatcggccacattggaactgagacacggtccaaactcctacggg<br>aggcagcagtggggaatattgcacaatgggcgaaagcctgatgcagcaacgccgcgtgagcgatgaaggccttcgggtcgt<br>aaagctctgtcctcaaggaagataatgacggtacttgaggaggaagccccggctaactacgtgccagcagccgcggtaatac<br>gtagggggctagcgttatccggatttactgggcgtaaagggtgcgtaggcggtcttttaagtcaggagtgaaaggctacggct<br>caaccgtagtaagctcttgaaactggaggacttgagtgcaggagaggagagtggaattcctagtgtagcggtgaaatgcgtag<br>atattaggaggaacaccagtagcgaaggcggctctctggactgtaactgacgctgaggcacgaaagcgtggggagcaaaca<br>ggattagataccctggtagtccacgccgtaaacgatgagtactaggtgtcgggggttaccccccctcggtgccgcagctaacgc<br>attaagtactccgcctggggagtacgctcgcaagagtgaaactcaaaggaattgacggggacccgcacaagtagcggagca<br>tgtggtttaattcgaagcaacgcgaagaaccttacctaagcttgacatccttttgaccgatgcctaatcgcatctttcccttcgggg<br>acagaagtgacaggtggtgcatggttgtcgtcagctcgtgtcgtgagatgttgggttaagtcccgcaacgagcgcaacccttgc<br>ctttagttgccatcattaagttgggcactctagagggactgccagggataacctggaggaaggtggggatgacgtcaaatcatc<br>atgccccttatgcttagggctacacacgtgctacaatgggtggtacagagggcagcgaagtcgtgaggccaagctaatccctt<br>aaagccattctcagttcggattgtaggctgaaactcgcctacatgaagctggagttactagtaatcgcagatcagaatgctgcgg<br>tgaatgcgttcccgggtcttgtacacaccgcccgtcacaccatgggagttgggggcgcccgaagccggctagctaaccttttg<br>gaagcggtcgtcgaaggtgaaaccaataactggggtgaagtcgtaacaaggtagccgtatcggaaggtgcggctggatcac<br>ctccttt |
| *Clostridium* *_bartlettii* | SEQ ID NO: 81 | atttgagagtttgatcctggctcaggatgaacgctggcggcgtgcctaacacatgcaagtcgagcgattctctttggagaagag<br>cggcggacgggtgagtaacgcgtgggtaacctgccctgtacacarggataacataccgaaaggtatgctaatacgggataac<br>ataagaaattcgcatgtttttcttatcaaagctccggcggtacaggatggacccgcgtctgattagctagaggtgaggtaacggc<br>tcaccaaggcgacgatcagtagccgacctgagagggtgatcggccacattggaactgagacacggtccaaactcctacggg<br>aggcagcagtggggaatattgcacaatgggcgaaagcctgatgcagcaacgccgcgtgagcgatgaaggccttcgggtcgt<br>aaagctctgtcctcaaggaagataatgacggtacttgaggaggaagccccggctaactacgtgccagcagccgcggtaatac<br>gtagggggctagcgttatccggatttactgggcgtaaagggtgcgtaggcggtcttttaagtcaggagtgaaaggctacggct<br>caaccgtagtaagctcttgaaactgggggacttgagtgcaggagaggagagtggaattcctagtgtagcggtgaaatgcgtag<br>atattaggaggaacaccagtagcgaaggcggctctctggactgtaactgacgctgaggcacgaaagcgtggggagcaaaca<br>ggattagataccctggtagtccacgccgtaaacgatgagtactagctgtcggaggttaccccttcggtggcgcagctaacgc<br>attaagtactccgcctggggagtacgctcgcaagagtgaaactcaaaggaattgacggggacccgcacaagtagcggagca<br>tgtggtttaattcgaagcaacgcgaagaaccttacctaagcttgacatccttttgaccgatgcctaatcgcatctttcccttcgggg |

TABLE 5-continued

Full length 16S rDNA sequences of species (negative correlates)

| Species Name | Sequence Identifier | 16S rDNA sequence |
|---|---|---|
| | | acagaagtgacaggtggtgcatggttgtcgtcagctcgtgtcgtgagatgttgggttaagtcccgcaacgagcgcaacccttgc<br>ctttagttgccatcattaagttgggcactctagagggactgccagggataacctggaggaaggtggggatgacgtcaaatcatc<br>atgccccttatgcttagggctacacacgtgctacaatgggtggtacagagggcagcgaagtcgtgaggccaagctaatccctt<br>aaagccattctcagttcggattgtaggctgaaactcgcctacatgaagctggagttactagtaatcgcagatcagaatgctgcgg<br>tgaatgcgttcccgggtcttgtacacaccgcccgtcacaccatgggagttgggggcgcccgaagccggctagctaacctttttg<br>gaagcggtcgtcgaaggtgaaaccaataactggggtgaagtcgtaacaaggtagccgtatcggaaggtgcggctggatcac<br>ctccttt |
| *Clostridium _bartlettii* | SEQ ID NO: 82 | gaggcagcagtggggaatattgcacaatgggcgaaagcctgatgcagcaacgccgcgtgagcgatgaaggccttcgggtc<br>gtaaagctctgtcctcaaggaagataatgacggtacttgaggaggaagccccggctaactacgtgccagcagccgcggtaat<br>acgtagggggctagcgttatccggatttactgggcgtaaagggtgcgtaggcggtcttttaagtcaggagtgaaaggctacgg<br>ctcaaccgtagtaagctcttgaaactggaggacttgagtgcaggagaggagagtggaattcctagtgtagcggtgaaatgcgt<br>agatattaggaggaacaccagtagcgaaggcggctctctggactgtaactgacgctgaggcacgaaagcgtggggagcaaa<br>caggattagataccctggtagtccacgccgtaaacgatgagtactagctgtcggaggttaccccttcggtggcgcagctaac<br>gcattaagtactccgcctggggagtacgctcgcaagagtgaaactcaaaggaattgacggggacccgcacaagtagcggag<br>catgtggtttaattcgaagcaacgcgaagaaccttacctaagcttgacatccttttgaccgatgcctaatcgcatctttcccttcgg<br>ggacagaagtgacaggtggtgcatggttgtcgtcagctcgtgtcgtgagatgagggttaagtcccgcaacgagcgcaaccct<br>tgcctttagttgccatcattaagttgggcactctagagggactgccagggataacctggaggaaggtggggatgacgtcaaatc<br>atcatgccccttatgcttagggctacacacgtgctacaatgggtggtacagagggcagcgaagtcgtgaggccaagctaatcc<br>cttaaagccattctcagttcggattgtaggctgaaactcgcctacatgaagctggagttactagtaatcgcagatcagaatgctgc<br>ggtgaatgcgttcccgggtcttgtacacaccgcccgtcacaccatgggagttgggggcgcccgaagccggctagctaaccttt<br>tggaagcggtcgtcgaaggtgaaaccaataactggggtgaagtcgtaacaaggtagccgtatcggaaggtgcggaggatc<br>acctccttt |
| *Clostridium _bartlettii* | SEQ ID NO: 83 | atttgagagtttgatcctggctcaggatgaacgctggcggcgtgcctaacacatgcaagtcgagcgatcttcttcggaagagag<br>cggcggacgggtgagtaacgcgtgggtaacctgccctgtacacacggataacataccgaaaggtatgctaatacgggataac<br>ataagaaattcgcatgtttttcttatcaaagctccggcggtacaggatggacccgcgtctgattagctagttggtgaggtaacggc<br>tcaccaaggcgacgatcagtagccgacctgagagggtgatcggccacattggaactgagacacggtccaaactcctacggg<br>aggcagcagtggggaatattgcacaatgggcgaaagcctgatgcagcaacgccgcgtgagcgatgaaggccttcgggtcgt<br>aaagctctgtcctcaaggaagataatgacggtacttgaggaggaagccccggctaactacgtgccagcagccgcggtaatac<br>gtagggggctagcgttatccggatttactgggcgtaaagggtgcgtaggcggtcttttaagtcaggagtgaaaggctacggct<br>caaccgtagtaagctcttgaaactggaggacttgagtgcaggagaggagagtggaattcctagtgtagcggtgaaatgcgtag<br>atattaggaggaacaccagtagcgaaggcggctctctggactgtaactgacgctgaggcacgaaagcgtggggagcaaaca<br>ggattagataccctggtagtccacgccgtaaacgatgagtactagctgtcggaggttaccccttcggtggcgcagctaacgc<br>attaagtactccgcctggggagtacgctcgcaagagtgaaactcaaaggaattgacggggacccgcacaagtagcggagca<br>tgtggtttaattcgaagcaacgcgaagaaccttacctaagcttgacatccttttgaccgatgcctaatcgcatctttcccttcgggg<br>acagaagtgacaggtggtgcatggttgtcgtcagctcgtgtcgtgagatgttgggttaagtcccgcaacgagcgcaacccttgc<br>ctttagttgccatcattaagttgggcactctagagggactgccagggataacctggaggaaggtggggatgacgtcaaatcatc<br>atgccccttatgcttagggctacacacgtgctacaatgggtggtacagagggcagcgaagtcgtgaggccaagctaatccctt<br>aaagccattctcagttcggattgtaggctgaaactcgcctacatgaagctggagttactagtaatcgcagatcagaatgctgcgg<br>tgaatgcgttcccgggtcttgtacacaccgcccgtcacaccatgggagttgggggcgcccgaagccggctagctaacctttttg<br>gaagcggtcgtcgaaggtgaaaccaataactggggtgaagtcgtaacaaggtagccgtatcggaaggtgcggctggatcac<br>ctccttt |
| *Clostridium _bartlettii* | SEQ ID NO: 84 | atgcagtcgagcgatcttcttcggagagagcggcggacgggggagtaacgcgtgggtaacctgccctgtacacacggattac<br>ataccgaaaggtatgctaatacgggataacataagaaattcgcatgtttttcttatcaaagctccggcggtacaggatggacccg<br>cgtctgattagctagttggtgaggtaacggctcaccaaggcgacgatcagtagccgacctgagagggtgatcggccacattg<br>gaactgagacacggtccaaactcctacgggaggcagcagtggggaatattgcacaatgggcgaaagcctgatgcagcaac |

TABLE 5-continued

Full length 16S rDNA sequences of species (negative correlates)

| Species Name | Sequence Identifier | 16S rDNA sequence |
|---|---|---|
| | | gccgcgtgagcgatgaaggccttcgggtcgtaaagctctgtcctcaaggaagataatgacggtacttgaggaggaagccccg<br>gctaactacgtgccagcagccgcggtaatacgtagggggctagcgttatccggatttactgggcgtaaagggtgcgtaggcg<br>gtcttttaagtcaggagtgaaaggctacggctcaaccgtagtaagctcttgaaactggaggacttgagtgcaggagaggagag<br>tggaattcctagtgtagcggtgaaatgcgtagatattaggaggaacaccagtagcgaaggcggctctctggactgtaactgac<br>gctgaggcacgaaagcgtggggagcaaacaggattaaataccctggtattccacgccgtaaacgatgagtactagctgtcgg<br>aggttaccccctttcggtggcgcagctaacgcataaatactcgcctggggagtacgctcgctagagtgaaattaacagaattga<br>ctggatcctgcccaattagcggaacatgtgcttgactcgtaccaacggaaaaaccttagcattcctgcttccttgacgtg |
| *Clostridium _bartlettii* | SEQ ID NO: 85 | atttgagagtttgatcctggctcaggatgaacgctggcggcgtgcctaacacatgcaagtcgagcgattctatcggagaagag<br>cggcggacgggtgagtaacgcgtgggtaacctgccctgtacacacggataacataccgaaaggtatgctaatacgggataac<br>ataagaaattcgcatgtttttcttatcaaagctccggcggtacaggatggacccgcgtctgattagctagttggtgaggtaacggc<br>tcaccaaggcgacgatcagtagccgacctgagagggtgatcggccacattggaactgagacacggtccaaactcctacggg<br>aggcagcagtggggaatattgcacaatgggcgaaagcctgatgcagcaacgccgcgtgagcgatgaaggccttcgggtcgt<br>aaagctctgtcctcaaggaagataatgacggtacttgaggaggaagccccggctaactacgtgccagcagccgcggtaatac<br>gtagggggctagcgttatccggatttactgggcgtaaagggtgcgtaggcggtcttttaagtcaggagtgaaaggctacggct<br>caaccgtagtaagctcttgaaactggaggacttgagtgcaggagaggagagtggaattcctagtgtagcggtgaaatgcgtag<br>atattaggaggaacaccagtagcgaaggcggctctctggactgtaactgacgctgaggcacgaaagcgtggggagcaaaca<br>ggattagataccctggtagtccacgccgtaaacgatgagtactagctgtcggaggttacccccttcggtggcgcagctaacgc<br>attaagtactccgcctggggagtacgctcgcaagagtgaaactcaaaggaattgacggggacccgcacaagtagcggagca<br>tgtggtttaattcgaagcaacgcgaagaaccttacctaagcttgacatccttttgaccgatgcctaatcgcatctttcccttcgggg<br>acagaagtgacaggtggtgcatggttgtcgtcagctcgtgtcgtgagatgttgggttaagtcccgcaacgagcgcaacccttgc<br>ctttagttgccatcattaagttgggcactctagagggactgccagggataacctggaggaaggtggggatgacgtcaaatcatc<br>atgccccttatgcttagggctacacacgtgctacaatgggtggtacagagggcagcgaagtcgtgaggccaagctaatccctt<br>aaagccattctcagttcggattgtaggctgaaactcgcctacatgaagctggagttactagtaatcgcagatcagaatgctgcgg<br>tgaatgcgttcccgggtcttgtacacaccgcccgtcacaccatgggagttgggggcgcccgaagccggctagctaacctttg<br>gaagcggtcgtcgaaggtgaaaccaataactggggtgaagtcgtaacaaggtagccgtatcggaaggtgcggctggatcac<br>ctccttt |
| *Clostridium _ramosum* | SEQ ID NO: 86 | atggagagtttgatcctggctcaggatgaacgctggcggcgtgcctaatacatgcaagtcgaacgcgagcacttgtgctcgag<br>tggcgaacgggtgagtaatacataagtaacctgccctagacagggggataactattggaaacgatagctaagaccgcataggt<br>acggacactgcatggtgaccgtattaaaagtgcctcaaagcactggtagaggatggacttatggcgcattagctggttggcgg<br>ggtaacggcccaccaaggcgacgatgcgtagccgacctgagagggtgaccggccacactgggactgagacacggcccag<br>actcctacgggaggcagcagtagggaattttcggcaatgggggaaaccctgaccgagcaacgccgcgtgaaggaagaagg<br>ttttcggattgtaaacttctgttataaaggaagaacggcggctacaggaaatggtagccgagtgacggtactttattagaaagcc<br>acggctaactacgtgccagcagccgcggtaatacgtaggtggcaagcgttatccggaattattgggcgtaaagagggagcag<br>gcggcagcaagggtctgtggtgaaagcctgaagcttaacttcagtaagccatagaaaccaggcagctagagtgcaggagag<br>gatcgtggaattccatgtgtagcggtgaaatgcgtagatatatggaggaacaccagtggcgaaggcgacgatctggcctgca<br>actgacgctcagtcccgaaagcgtggggagcaaataggattagataccctagtagtccacgccgtaaacgatgagtactaagt<br>gttggatgtcaaagttcagtgctgcagttaacgcaataagtactccgcctgagtagtacgttcgcaagaatgaaactcaaagga<br>attgacgggggcccgcacaagcggtggagcatgtggtttaattcgaagcaacgcgaagaaccttaccaggtcttgacatactc<br>ataaaggctccagagatggagagatagctatatgagatacaggtggtgcatggttgtcgtcagctcgtgtcgtgagatgttggg<br>ttaagtcccgcaacgagcgcaacccttatcgttagttaccatcattaagttggggactctagcgagactgccagtgacaagctg<br>gaggaaggcggggatgacgtcaaatcatcatgccccttatgacctgggctacacacgtgctacaatggatggtgcagaggga<br>agcgaagccgcgaggtgaagcaaaacccataaaaccattctcagttcggattgtagtctgcaactcgactacatgaagttggaa<br>tcgctagtaatcgcgaatcagcatgtcgcggtgaatacgttctcgggccttgtacacaccgcccgtcacaccacgagagttgat<br>aacacccgaagccggtggcctaaccgcaaggaaggagctgtctaaggtgggattgatgattggggtgattgtcgtaacaaggt<br>atccctacgggaacgtggggatggatcacctccttt |

TABLE 5-continued

Full length 16S rDNA sequences of species (negative correlates)

| Species Name | Sequence Identifier | 16S rDNA sequence |
| --- | --- | --- |
| *Clostridium _scindens* | SEQ ID NO: 87 | cagcagccgcggtaatacgtagggggcaagcgttatccggatttactgggtgtaaagggagcgtagacggcgatgcaagcc agatgtgaaagcccggggctcaaccccgggactgcatttggaactgcgtggctggagtgtcggagaggcaggcggaattcc tagtgtagcggtgaaatgcgtagatattaggaggaacaccagtggcgaaggcggcctgctggacgatgactgacgttgaggc tcgaaagcgtggggagcaaacaggattagataccctggtagtccacgccgtaaacgatgactactaggtgtcgggtggcaag gccattcggtgccgcagcaaacgcaataagtagtccacctggggagtacgttcgcaagaatgaaactcaaaggaattgacgg ggacccgcacaagcggtggagcatgtggtttaattcgaagcaacgcgaagaaccttacctgatcttgacatcccgatgccaaa gcgcgtaacgcgctctttcttcggaacatcggtgacaggtggtgcatggttgtcgtcagctcgtgtcgtgagatgttgggttaagt cccgcaacgagcgcaacccctatcttcagtagccagcattttggatgggcactctggagagactgccagggagaacctggag gaaggtggggatgacgtcaaatcatcatgccccttatgaccagggctacacacgtgctacaatggcgtaaacaaagggaggc gaacccgcgagggtgggcaaatcccaaaaataacgtctcagttcggattgtagtctgcaactcgactacatgaagctggaatc gctagtaatcgcgaatcagaatgtcgcggtgaatacgttcccgggtcttgtacacaccgcccgtcacaccatgggagtcagtaa cgcccgaagccggtgacccaacccgtaagggagggagccgtcgaaggtgggaccgataactggggtgaagtcgtaacaa ggtagccgtatcggaaggtgcggctggatcacctccttt |
| *Clostridium _scindens* | SEQ ID NO: 88 | aacgagagtttgatcctggctcaggatgaacgctggcggcgtgcctaacacatgcaagtcgaacgaagcgcctggccccga cttcttcggaacgaggagccttgcgactgagtggcggacgggtgagtaacgcgtgggcaacctgccttgcactgggggataa cagccagaaatggctgctaataccgcataagaccgaagcgccgcatggcgcggcggccaaagccccggcggtgcaagat gggcccgcgtctgattaggtagttggcggggtaacggcccaccaagccgacgatcagtagccgacctgagagggtgaccg gccacattgggactgagacacggcccagactcctacgggaggcagcagtggggaatattgcacaatgggggaaaccctgat gcagcgacgccgcgtgaaggatgaagtatttcggtatgtaaacttctatcagcagggaagaagatgacggtacctgactaaga agccccggctaactacgtgccagcagccgcggtaatacgtagggggcaagcgttatccggatttactgggtgtaaagggagc gtagacggcgatgcaagccagatgtgaaagcccggggctcaaccccgggactgcatttggaactgcgtggctggagtgtcg gagaggcaggcggaattcctagtgtagcggtgaaatgcgtagatattaggaggaacaccagtggcgaaggcggcctgctgg acgatgactgacgttgaggctcgaaagcgtggggagcaaacaggattagataccctggtagtccacgccgtaaacgatgact actaggtgtcgggtggcaaggccattcggtgccgcagcaaacgcaataagtagtccacctggggagtacgttcgcaagaatg aaactcaaaggaattgacggggacccgcacaagcggtggagcatgtggtttaattcgaagcaacgcgaagaaccttacctga tcttgacatcccgatgccaaagcgcgtaacgcgctctttcttcggaacatcggtgacaggtggtgcatggttgtcgtcagctcgt gtcgtgagatgttgggttaagtcccgcaacgagcgcaacccctatcttcagtagccagcttttaggatgggcactctggagaga ctgccagggagaacctggaggaaggtggggatgacgtcaaatcatcatgccccttatgaccagggctacacacgtgctacaa tggcgtaaacaaagggaggcgaacccgcgagggtgggcaaatcccaaaaataacgtctcagttcggattgtagtctgcaact cgactacatgaagttggaatcgctagtaatcgcgaatcagaatgtcgcggtgaatacgttcccgggtcttgtacacaccgcccg tcacaccatgggagtcagtaacgcccgaagccggtgacccaacccgtaagggagggagccgtcgaaggtgggaccgataa ctggggtgaagtcgtaacaaggtagccgtatcggaaggtgcggctggatcacctccttt |
| *Anaerotrunc us_colihomi nis* | SEQ ID NO: 89 | caaagagtttgatcctggctcaggacgaacgctggcggcgcgcctaacacatgcaagtcgaacggagcttacgttttgaagttt tcggatggatgaatgtaagcttagtggcggacgggtgagtaacacgtgagcaacctgcctttcagagggggataacagccgg aaacggctgctaataccgcatgatgttgcgggggcacatgcccctgcaaccaaaggagcaatccgctgaaagatgggctcgc gtccgattagccagttggcggggtaacggcccaccaaagcgacgatcggtagccggactgagaggttgaacggccacattg ggactgagacacggcccagactcctacgggaggcagcagtggggaatattgcacaatgggcgaaagcctgatgcagcgac gccgcgtgagggaagacggtcttcggattgtaaacctctgtctttggggaagaaaatgacggtacccaaagaggaagctccg gctaactacgtgccagcagccgcggtaatacgtagggagcaagcgttgtccggaattactgggtgtaaagggagcgtaggc gggatggcaagtagaatgttaaatccatcggctcaaccggtggctgcgttctaaactgccgttcttgagtgaagtagaggcagg cggaattcctagtgtagcggtgaaatgcgtagatattaggaggaacaccagtggcgaaggcggcctgctgggctttaactgac gctgaggctcgaaagcgtggggagcaaacaggattagataccctggtagtccacgccgtaaacgatgattactaggtgtggg gggactgaccccttccgtgccgcagttaacacaataagtaatccacctggggagtacggccgcaaggttgaaactcaaagga attgacgggggcccgcacaagcagtggagtatgtggtttaattcgaagcaacgcgaagaaccttaccaggtcttgacatcgga tgcatagcctagagataggtgaagcccttcggggcatccagacaggtggtgcatggttgtcgtcagctcgtgtcgtgagatgtt gggttaagtcccgcaacgagcgcaacccttattattagttgctacgcaagagcactctaatgagactgccgttgacaaaacgga |

TABLE 5-continued

| Full length 16S rDNA sequences of species (negative correlates) | | |
|---|---|---|
| Species Name | Sequence Identifier | 16S rDNA sequence |
| | | ggaaggtggggatgacgtcaaatcatcatgccccttatgacctgggctacacacgtactacaatggcactaaaacagagggc<br>ggcgacaccgcgaggtgaagcgaatcccgaaaaagtgtctcagttcagattgcaggctgcaacccgcctgcatgaagtcgg<br>aattgctagtaatcgcggatcagcatgccgcggtgaatacgttcccgggccttgtacacaccgcccgtcacaccatgggagtc<br>ggtaacacccgaagccagtagcctaaccgcaagggggcgctgtcgaaggtgggattgatgactggggtgaagtcgtaaca<br>aggtagccgtatcggaaggtgcggctggatcacctccttt |
| *Anaerotruncus_colihominis* | SEQ ID NO: 90 | caaagagtttgatcctggctcaggacgaacgctggcggcgcgcctaacacatgcaagtcgaacggagcttacgttttgaagttt<br>tcggatggacgaatgtaagcttagtggcggacgggtgagtaacacgtgagcaacctgcctttcagagggggataacagccg<br>gaaacggctgctaataccgcatgatgttgcgggggcacatgcccctgcaaccaaaggagcaatccgctgaaagatgggctc<br>gcgtccgattagccagttggcggggtaacggcccaccaaagcgacgatcggtagccggactgagaggttgaacggccacat<br>tgggactgagacacggcccagactcctacgggaggcagcagtgggggatattgcacaatgggcgaaagcctgatgcagcg<br>acgccgcgtgagggaagacggtcttcggattgtaaacctctgtctttggggaagaaaatgacggtacccaaagaggaagctc<br>cggctaactacgtgccagcagccgcggtaatacgtagggagcaagcgttgtccggaattactgggtgtaaagggagcgtag<br>gcgggatggcaagtagaatgttaaatccatcggctcaaccggtggctgcgttctaaactgccgttcttgagtgaagtagaggca<br>ggcggaattcctagtgtagcggtgaaatgcgtagatattaggaggaacaccagtggcgaaggcggcctgctgggctttaactg<br>acgctgaggctcgaaagcgtggggagcaaacaggattagataccctggtagtccacgccgtaaacgatgattactaggtgtg<br>gggggactgaccccttccgtgccgcagttaacacaataagtaatccacctggggagtacggccgcaaggttgaaactcaaag<br>gaattgacgggggcccgcacaagcagtggagtatgtggtttaattcgaagcaacgcgaagaaccttaccaggtcttgacatcg<br>gatgcatagcctagagataggtgaagcccttcggggcatccagacaggtggtgcatggttgtcgtcagctcgtgtcgtgagat<br>gagggttaagtcccgcaacgagcgcaacccttattattagttgctacgcaagagcactctaatgagactgccgttgacaaaacg<br>gaggaaggtggggatgacgtcaaatcatcatgccccttatgacctgggctacacacgtactacaatggcactaaaacagagg<br>gcggcgacaccgcgaggtgaagcgaatcccgaaaaagtgtctcagttcagattgcaggctgcaacccgcctgcatgaagtc<br>ggaattgctagtaatcgcggatcagcatgccgcggtgaatacgttcccgggccttgtacacaccgcccgtcacaccatgggag<br>tcggtaacacccgaagccagtagcctaaccgcaagggggcgctgtcgaaggtgggattgatgactggggtgaagtcgtaa<br>caaggtagccgtatcggaaggtgcggctggatcacctccttt |
| *Anaerotruncus_colihominis* | SEQ ID NO: 91 | tcaaagagtttgatcctggctcaggacgaacgctggcggcgcgcctaacacatgcaagtcgaacggagcttacgttttgaagtt<br>ttcggatggatgaatgtaagcttagtggcggacgggtgagtaacacgtgagcaacctgcctttcagagggggataacagccg<br>gaaacggctgctaataccgcatgatgttgcgggggcacatgcccctgcaaccaaaggagcaatccgctgaaagatgggctc<br>gcgtccgattagccagttggcggggtaacggcccaccaaagcgacgatcggtagccggactgagaggttgaacggccacat<br>tgggactgagacacggcccagactcctacgggaggcagcagtgggggatattgcacaatgggcgaaagcctgatgcagcg<br>acgccgcgtgagggaagacggtcttcggattgtaaacctctgtctttggggaagaaaatgacggtacccaaagaggaagctc<br>cggctaactacgtgccagcagccgcggtaatacgtagggagcaagcgttgtccggaattactgggtgtaaagggagcgtag<br>gcgggatggcaagtagaatgttaaatccatcggctcaaccggtggctgcgttctaaactgccgttcttgagtgaagtagaggca<br>ggcggaattcctagtgtagcggtgaaatgcgtagatattaggaggaacaccagtggcgaaggcggcctgctgggctttaactg<br>acgctgaggctcgaaagcgtggggagcaaacaggattagataccctggtagtccacgccgtaacgatgattactaggtgtgg<br>ggggactgaccccttccgtgccgcagttaacacataagtaatccacctggggagtacggccgcaggtgaactcaaggattga<br>cggggcccgcacagcagtgagtatgtggtttatcgagcacgcgagactacagtctgacatcgatgcatagctagagatagtga<br>gccctcgggcatccagacaggtgggtgcatgggtgtcg |
| *Anaerotruncus_colihominis* | SEQ ID NO: 92 | caaagagtttgatcctggctcaggacgaacgctggcggcgcgcctaacacatgcaagtcgaacggagcttacgttttgaagttt<br>tcggatggatgaatgtaagcttagtggcggacgggtgagtaacacgtgagcaacctgcctttcagagggggataacagccgg<br>aaacggctgctaataccgcatgatgttgcgggggcacatgcccctgcaaccaaaggagcaatccgctgaaagatgggctcgc<br>gtccgattagccagttggcggggtaacggcccaccaaagcgacgatcggtagccggactgagaggttgaacggccacattg<br>ggactgagacacggcccagactcctacgggaggcagcagtgggggatattgcacaatgggcgaaagcctgatgcagcgac<br>gccgcgtgagggaagacggtcttcggattgtaaacctctgtctttggggaagaaaatgacggtacccaaagaggaagctccg<br>gctaactacgtgccagcagccgcggtaatacgtagggagcaagcgttgtccggaattactgggtgtaaagggagcgtaggc<br>gggatggcaagtagaatgttaaatccatcggctcaaccggtggctgcgttctaaactgccgttcttgagtgaagtagaggcagg |

TABLE 5-continued

| Full length 16S rDNA sequences of species (negative correlates) | | |
|---|---|---|
| Species Name | Sequence Identifier | 16S rDNA sequence |
| | | cggaattcctagtgtagcggtgaaatgcgtagatattaggaggaacaccagtggcgaaggcggcctgctgggctttaactgac<br>gctgaggctcgaaagcgtggggagcaaacaggattagataccctggtagtccacgccgtaaacgatgattactaggtgtggg<br>gggactgaccccttccgtgccgcagttaacacaataagtaatccacctggggagtacggccgcaaggttgaaactcaaagga<br>attgacgggggcccgcacaagcagtggagtatgtggtttaattcgaagcaacgcgaagaaccttaccaggtcttgacatcgga<br>tgcatagcctagagataggtgaagcccttcggggcatccagacaggtggtgcatggttgtcgtcagctcgtgtcgtgagatgtt<br>gggttaagtcccgcaacgagcgcaacccttattattagttgctacgcaagagcactctaatgagactgccgttgacaaaacgga<br>ggaaggtggggatgacgtcaaatcatcatgccccttatgacctgggctacacacgtactacaatggcactaaaacagagggc<br>ggcgacaccgcgaggtgaagcgaatcccgaaaaagtgtctcagttcagattgcaggctgcaacccgcctgcatgaagtcgg<br>aattgctagtaatcgcggatcagcatgccgcggtgaatacgttcccgggccttgtacacaccgcccgtcacaccatgggagtc<br>ggtaacacccgaagccagtagcctaaccgcaaggggggcgctgtcgaaggtgggattgatgactggggtgaagtcgtaaca<br>aggtagccgtatcggaaggtgcggctggatcacctccttt |
| *Clostridium _spiroforme* | SEQ ID NO: 93 | atggagagtttgatcctggctcaggatgaacgctggcggcgtgcctaatacatgcaagtcgaacgcgagcagcaatgctcga<br>gtggcgaacgggtgagtaatacataagtaacctgccctagacaggggataactgctggaaacggcagctaagaccgcata<br>ggtatggacactgcatggtgaccatattaaaagtgccaaggcactggtagaggatggacttatggcgcattagctggttggtga<br>ggtaacagctcaccaaggcgacgatgcgtagccgacctgagagggtgaccggccacactgggactgagacacggcccag<br>actcctacgggaggcagcagtagggaattttcggcaatgggggaaccctgaccgagcaacgccgcgtgaaggaagaagg<br>aattcgttctgtaaacttctgttataaaggaagaacggcggatatagggaatgatatccgagtgacggtactttatgagaaagcc<br>acggctaactacgtgccagcagccgcggtaatacgtaggtggcgagcgttatccggaattattgggcgtaaagagggagcag<br>gcggcggcagaggtctgtggtgaaagactgaagcttaacttcagtaagccatagaaaccgggctgctagagtgcaggagag<br>gatcgtggaattccatgtgtagcggtgaaatgcgtagatatatggaggaacaccagtggcgaaggcgacggtctggcctgtaa<br>ctgacgctcattcccgaaagcgtggggagcaaataggattagataccctagtagtccacgccgtaaacgatgagtactaagtgt<br>tgggagtcaaatttcagtgctgcagttaacgcaataagtactccgcctgagtagtacgttcgcaagaatgaaactcaaaggaatt<br>gacgggggcccgcacaagcggtggagcatgtggtttaattcgaagcaacgcgaagaaccttaccaggtcttgacatccggat<br>aaagacctcagagatgaggggatagatatatccgagacaggtggtgcatggttgtcgtcagctcgtgtcgtgagatgttgggtt<br>aagtcccgcaacgagcgcaacccttgtcgctagttaccatcattaagaggggactctagcgagactgccagtgacaagctgg<br>aggaaggcggggatgacgtcaaatcatcatgccccttatgacctggctacacacgtgctacaatgatggagcagagggaagc<br>gaagccgcgagtgagcaaacccataaaccattctcagtcggattgtagtctgcactcgactacatga |
| *Clostridium _spiroforme* | SEQ ID NO: 94 | atggagagtttgatcctggctcaggatgaacgctggcggcgtgcctaatacatgcaagtcgaacgcgagcagcaatgctcga<br>gtggcgaacgggtgagtaatacataagtaacctgccctagacaggggataactgctggaaacggcagctaagaccgcata<br>ggtatggacactgcatggtgaccatattaaaagtgccaaggcactggtagaggatggacttatggcgcattagctggttggtga<br>ggtaacggctcaccaaggcgacgatgcgtagccgacctgagagggtgaccggccacactgggactgagacacggcccag<br>actcctacgggaggcagcagtagggaattttcggcaatgggggaaccctgaccgagcaacgccgcgtgaaggaagaagg<br>aattcgttctgtaaacttctgttataaaggaagaacggcggatatagggaatgatatccgagtgacggtactttatgagaaagcc<br>acggctaactacgtgccagcagccgcggtaatacgtaggtggcgagcgttatccggaattattgggcgtaaagagggagcag<br>gcggcggcagaggtctatggtgaaagactgaagcttaacttcagtaagccatagaaaccgggctgctagagtgcaggagag<br>gatcgtgaattccatgtgtagcggtgaaatgcgtagatatatggaggaacaccagtggcgaaggcgacggtctgcctgtaact<br>gacgctcattcccgaaagcgtggggagcaaataggattagataccctagtagtccacgccgtaacgatgagtactaagtgtgg<br>gagtcaaatttcagtgctgcagttaacgcaataagtacctccgccttgaatagtacgttcgcaaga |
| *Clostridium _spiroforme* | SEQ ID NO: 95 | atggagagtttgatcctggctcaggatgaacgctggcggcgtgcctaatacatgcaagtcgaacgcgagcagcaatgctcga<br>gtggcgaacgggtgagtaatacataagtaacccgccctagacaggggataactgctggaaacggcagctaagaccgcata<br>ggtatggacactgcatggtgaccatattaaaagtgccaaggcactggtagaggatggacttatggcgcattagctggttggtga<br>ggtaacggctcaccaaggcgacgatgcgtagccgacctgagagggtgaccggccacactgggactgagacacggcccag<br>actcctacgggaggcagcagtagggaattttcggcaatgggggaaccctgaccgagcaacgccgcgtgaaggaagaagg<br>aattcgttctgtaaacttctgttataaaggaagaacggcggatatagggaatgatatccgagtgacggtactttatgagaaagcc<br>acggctaactacgtgccagcagccgcggtaatacgtaggtggcgagcgttatccggaattattgggcgtaaagagggagcag |

TABLE 5-continued

| Species Name | Sequence Identifier | 16S rDNA sequence |
|---|---|---|
| | | gcggcggcagaggtctatggtgaaagactgaagcttaacttcagtaagccatagaaaccgggctgctagagtgcaggagag gatcgtggaattccatgtgtagcggtgaaatgcgtagatatatggaggaacaccagtggcgaaggcgacggtctggcctgtaa ctgacgctcattcccgaaagcgtggggagcaaataggattagataccctagtagtccacgccgtaaacgatgagtactaagtgt tgggagtcaaatttcagtgctgcagttaacgcaataagtactccgcctgagtagtacgttcgcaagaatgaaactcaaaggaatt gacgggggcccgcacaagcggtggagcatgtggtttaattcgaagcaacgcgaagaaccttaccaggtcttgacatccggat aaagacctcagagatgaggggatagatatatccgagacaggtggtgcatggttgtcgtcagctcgtgtcgtgagatgttgggtt aagtcccgcaacgagcgcaacccttgtcgctagttaccatcattaagttggggactctagcgagactgccagtgacaagctgg aggaaggcggggatgacgtcaaatcatcatgccccttatgacctgcgctacacacgtgctacaatgtatggagcagagggaa gcgaagccgcgaggtgaagcaaacccataaaccattctcagttcggattgtagtctgcaactcgactacatgagtgtatcgcta gtatcgcgatcagcatgtcgcgtgaatacgttctcggccagtacacaccccgcccgtcaacaccattg |
| *Anaerofustis _stercoriho minis* | SEQ ID NO: 96 | ttttgagagtttgatcctggctcaggacgaacgctggcggcgtgcttaacacatgcaagtcgaacgagaaacttataaatgatcc ttcgggtgaatctataagcggacagtggcgaacgggtgagtaacgcgtaggtaaccaacctcatgcaggggatagcccag ggaaacttggattaaacccgcataagaccacagcaccgcatggtgcaggggtaaaaactccggtggcatgagacggacctg cgtcttattaggtagttggtgaggtaacggctcaccaagccaacgatgagtagccgacctgagagggtgatcggccacattgg gactgagacacggcccagactcctacgggaggcagcagtggggaatattgcgcaatgggggaaaccctgacgcagcaac gccgcgtgagcgatgaaggttttcggatcgtaaagctctgtctttggggaagataatgacggtacccaaggaggaagctccgg ctaactacgtgccagcagccgcggtaatacgtagggagcaagcgttgtccggattcactgggcgtaaagagcacgtaggcg gttaattaagtcaggtgtgaaagttttcggctcaaccggaaaagtgcacttgaaactggataacttgagtatcggagaggtaagc ggaattcctagtgtagcggtgaaatgcgtagagattaggaagaacaccggtggcgaaggcggcttactggacgataactgac gctgaggtgcgaaagcgtggggagcgaacaggattagataccctggtagtccacgccgtaaacgatgaatactaggtgttgg ggtaactcagtgccgcagttaacacattaagtattccgcctggggagtacgctcgcaagagtgaaactcaaaggaattgacgg gggcccgcacaagcagcggagcatgtggtttaattcgaagcaacgcgaagaaccttaccaggtcttgacatcccttgaccgcc taagagattaggctttccttcgggacaaggagacaggtggtgcatggttgtcgtcagctcgtgtcgtgagatgttgggttaagtc ccgcaacgagcgcaacccttatgtttagttactaacattcagttgaggactctagacagactgcccttgaaagagggaggaagg tggggacgacgtcaaatcatcatgccccttacgacctgggctacacacgtgctacaatggtctgtacagagggttgcgaagca gtgatgctaagctaatctcaaaaagcagatctcagttcggattgcaggctgcaactcgcctgcatgaagtcggagttgctagtaa tcgcgaatcagaatgtcgcggtgaatgcgttcccgggccttgtacacaccgcccgtcacaccacgagagttggtaacacccga agccagtgagctaaccattaggaggcagctgtcgaaggtgggatcagtaattggggtgaagtcgtaacaaggtagccgtatc ggaaggtgcggctggatcacctccttt |
| *Anaerofustis _stercoriho minis* | SEQ ID NO: 97 | ttttgagagtttgatcctggctcaggacgaacgctggcggcgtgcttaacacatgcaagtcgaacgagaaacttataaatgatcc ttcgggtgaatctataagcggacagtggcgaacgggtgagtaacgcgtaggtaaccaacctcatgcaggggatagcccag ggaaacttggattaaacccgcataagaccacagcaccgcatggtgcaggggtaaaaactccggtggcatgagacggacctg cgtcttattaggtagttggtgaggtaacggctcaccaagccaacgatgagtagccgacctgagagggtgatcggccacattgg gactgagacacggcccagactcctacgggaggcagcagtggggaatattgcgcaatgggggaaaccctgacgcagcaac gccgcgtgagcgatgaaggttttcggatcgtaaagctctgtctttggggaagataatgacggtacccaaggaggaagctccgg ctaactacgtgccagcagccgcggtaatacgtagggagcaagcgttgtccggattcactgggcgtaaagagcacgtaggcg gttaattaagtcaggtgtgaaagttttcggctcaaccggaaaagtgcacttgaaactggataacttgagtatcggagaggtaagc ggaattcctagtgtagcggtgaaatgcgtagagattaggaagaacaccggtggcgaaggcggcttactggacgataactgac gctgaggtgcgaaagcgtggggagcgaacaggattagataccctggtagtccacgccgtaaacgatgaatactaggtgttgg ggtaactcagtgccgcagttaacacattaagtattccgcctggggagtacgctcgcaagagtgaaactcaaaggaattgacgg gggcccgcacaagcagcggagcatgtggtttaattcgaagcaacgcgaagaaccttaccaggtcttgacatcccttgaccgcc taagagattaggctttccttcgggacaaggagacaggtggtgcatggttgtcgtcagctcgtgtcgtgagatgttgggttaagtc ccgcaacgagcgcaacccttatgtttagttactaacattcagttgaggactctagacagactgcccttgaaagagggaggaagg tggggacgacgtcaaatcatcatgccccttacgacctgggctacacacgtgctacaatggtctgtacagagggttgcgaagca gtgatgctaagctaatctcaaaaagcagatctcagttcggattgcaggctgcaactcgcctgcatgaagtcggagttgctagtaa tcgcgaatcagaatgtcgcggtgaatgcgttcccgggccttgtacacaccgcccgtcacaccacgagagttggtaacacccga |

TABLE 5-continued

Full length 16S rDNA sequences of species (negative correlates)

| Species Name | Sequence Identifier | 16S rDNA sequence |
|---|---|---|
| | | agccagtgagctaaccattaggaggcagctgtcgaaggtgggatcagtaattggggtgaagtcgtaacaaggtagccgtatc<br>ggaaggtgcggctggatcacctccttt |
| Clostridiales _*bacterium*_ 1_7_47FAA | SEQ ID NO: 98 | tttgagagtttgatcctggctcaggatgaacgctggcggcgtgcctaacacatgcaagtcgaacgaagcatcttataggaagttt<br>tcggatggaatatgggatgactgagtggcggacgggtgagtaacgcgtggataacctgcctcacactggggataacagtta<br>gaaatggctgctaataccgcataagcgcacagtaccgcatggtacggtgtgaaaaacccaggtggtgtgagatggatccgcg<br>tctgattagccagttggcggggtaacggcccaccaaagcgacgatcagtagccgacctgagagggtgaccggccacattgg<br>gactgagacacggcccaaactcctacgggaggcagcagtggggaatattgcacaatgggcgaaagcctgatgcagcgacg<br>ccgcgtgagtgaagaagtatctcggtatgtaaagctctatcagcagggaagaaaatgacggtacctgactaagaagccccgg<br>ctaactacgtgccagcagccgcggtaatacgtagggggcaagcgttatccggatttactgggtgtaaagggagcgtagacgg<br>cgatgcaagtctgaagtgaaagcccggggctcaaccccgggactgctttggaaactgtgtggctggagtgcaggagaggta<br>agtggaattcctagtgtagcggtgaaatgcgtagatattaggaggaacaccagtggcgaaggcggcttactggactgtaactg<br>acgttgaggctcgaaagcgtggggagcaaacaggattagataccctggtagtccacgccgtaaacgatgaatgctaggtgtc<br>ggggggcaaagcccctcggtgccgccgctaacgcaataagcattccacctggggagtacgttcgcaagaatgaaactcaaa<br>ggaattgacggggacccgcacaagcggtggagcatgtggtttaattcgaagcaacgcgaagaaccttaccaagtcttgacatc<br>cccctgaccggacagtaacgtgtcccttccttcgggacaggggagacaggtggtgcatggttgtcgtcagctcgtgtcgtgag<br>atgttgggttaagtcccgcaacgagcgcaacccttatccttagtagccagcatttcgggtgggcactctagggagactgccagg<br>gataacctggaggaaggtggggatgacgtcaaatcatcatgccccttatgatttgggctacacacgtgctacaatggcgtaaac<br>aaagggaagcaccctgcgaaggtgagcaaatcccaaaaataacgtcccagttcggactgtagtctgcaacccgactacacga<br>agctggaatcgctagtaatcgcggatcagaatgccgcggtgaatacgttcccgggtcttgtacacaccgcccgtcacaccatg<br>ggagtcagcaacgcccgaagtcagtgacccaaccgaaaggagggagctgccgaaggcggggcaggtaactggggtgaa<br>gtcgtaacaaggtagccgtatcggaaggtgcggctggatcacctccttt |
| *Coprococcu s_comes* | SEQ ID NO: 99 | aacgagagtttgatcctggctcaggatgaacgctggcggcgtgcttaacacatgcaagtcgaacgaagcactttaacctgattc<br>ttcggatgaaggtttttgtgactgagtggcggacgggtgagtaacgcgtgggtaacctgcctcatacagggggataacagttag<br>aaatgactgctaataccgcataagaccacagagccgcatggctcggtgggaaaaactccggtggtatgagatggacccgcgt<br>ctgattaggtagttggtggggtaacggcctaccaagccaacgatcagtagccgacctgagagggtgaccggccacattggga<br>ctgagacacggcccaaactcctacgggaggcagcagtggggaatattgcacaatgggggaaaccctgatgcagcgacgcc<br>gcgtgagcgaagaagtatttcggtatgtaaagctctatcagcagggaagaaaatgacggtacctgactaagaagcaccggcta<br>aatacgtgccagcagccgcggtaatacgtatggtgcaagcgttatccggatttactgggtgtaaagggagcgtagacggctgt<br>gtaagtctgaagtgaaagcccggggctcaaccccgggactgctttggaaactatgcagctagagtgtcggagaggtaagtgg<br>aattcccagtgtagcggtgaaatgcgtagatattgggaggaacaccagtggcgaaggcggcttactggacgatgactgacgtt<br>gaggctcgaaagcgtggggagcaaacaggattagataccctggtagtccacgccgtaaacgatgactactaggtgtcgggg<br>agcaaagctcttcggtgccgcagcaaacgcaataagtagtccacctggggagtacgttcgcaagaatgaaactcaaaggaatt<br>gacggggacccgcacaagcggtggagcatgtggtttaattcgaagcaacgcgaagaaccttacctgctcttgacatcccggt<br>gaccggcgtgtaatgacgccttttcttcggaacaccggtgacaggtggtgcatggttgtcgtcagctcgtgtcgtgagatgttgg<br>gttaagtcccgcaacgagcgcaacccttatcttcagtagccagcaattcggatgggcactctggagagactgccagggataac<br>ctggaggaaggtggggatgacgtcaaatcatcatgccccttatgagcagggctacacacgtgctacaatggcgtaaacaaag<br>ggaagcgagcctgcgagggtaagcaaatctcaaaaataacgtctcagttcggattgtagtctgcaactcgactacatgaagctg<br>gaatcgctagtaatcgcgaatcagcatgtcgcggtgaatacgttcccgggtcttgtacacaccgcccgtcacaccatgggagtt<br>ggtaacgcccgaagtcagtgacccaaccgtaaggagggagctgccgaaggtgggaccgataactggggtgaagtcgtaac<br>aaggtagccgtatcggaaggtgcggctggatcacctccttt |
| *Roseburia_i ntestinalis* | SEQ ID NO: 100 | atgagagtttgatcctggctcaggatgaacgctggcggcgtgcttaacacatgcaagtcgaacgaagcactttatttgatttcttc<br>ggaatgaagattttgtgactgagtggcggacgggtgagtaacgcgtgggtaacctgcctcatacagggggataacagttgga<br>aacgactgctaataccgcataagcgcacagggtcgcatgacctggtgtgaaaaactccggtggtatgagatggacccgcgtct<br>gattagccagttggtggggtaacggcctaccaaagcgacgatcagtagecgacctgagagggtgaccggccacattgggac<br>tgagacacggcccaaactcctacgggaggcagcagtggggaatattgcacaatgggggaaaccctgatgcagcgacgccg |

TABLE 5-continued

Full length 16S rDNA sequences of species (negative correlates)

| Species Name | Sequence Identifier | 16S rDNA sequence |
|---|---|---|
| | | cgtgagcgaagaagtatttcggtatgtaaagctctatcagcagggaagaagaaatgacggtacctgactaagaagcaccggct<br>aaatacgtgccagcagccgcggtaatacgtatggtgcaagcgttatccggatttactgggtgtaaagggagcgcaggcggta<br>cggcaagtctgatgtgaaagcccggggctcaaccccggtactgcattggaaactgtcggactagagtgtcggaggggtaagt<br>ggaattcctagtgtagcggtgaaatgcgtagatattaggaggaacaccagtggcgaaggcggcttactggacgattactgacg<br>ctgaggctcgaaagcgtggggagcaaacaggattagataccctggtagtccacgccgtaaacgatgaatactaggtgtcggg<br>gagtattgctcttcggtgccgcagcaaacgcaataagtattccacctggggagtacgttcgcaagaatgaaactcaaaggaatt<br>gacggggacccgcacaagcggtggagcatgtggtttaattcgaagcaacgcgaagaaccttaccaagtcttgacatcccggt<br>gacagaacatgtaatgtgttttctcttcggagcatcggtgacaggtggtgcatggagtcgtcagctcgtgtcgtgagatgttggg |
| *Blautia_hydrogenotrophica* | SEQ ID NO: 101 | cagagagtttgatcctggctcaggatgaacgctggcggcgtgcttaacacatgcaagtcgaacgaagcgatagagaacgga<br>gatttcggttgaagttttctattgactgagtggcggacgggtgagtaacgcgtgggtaacctgccctatacagggggataacagt<br>tagaaatgactgctaataccgcataagcgcacagcttcgcatgaagcggtgtgaaaaactgaggtggtataggatggacccge<br>gttggattagctagttggtgaggtaacggcccaccaaggcgacgatccatagccggcctgagagggtgaacggccacattgg<br>gactgagacacggcccaaactcctacgggaggcagcagtggggaatattgcacaatgggggaaaccctgatgcagcgacg<br>ccgcgtgaaggaagaagtatctcggtatgtaaacttctatcagcagggaagaaagtgacggtacctgactaagaagccccgg<br>ctaattacgtgccagcagccgcggtaatacgtaaggggcaagcgttatccggatttactgggtgtaaagggagcgtagacggt<br>ttggcaagtctgatgtgaaaggcatgggctcaacctgtggactgcattggaaactgtcagacttgagtgccggagaggcaagc<br>ggaattcctagtgtagcggtgaaatgcgtagatattaggaggaacaccagtggcgaaggcggcctgctggacggtaactgac<br>gttgaggctcgaaagcgtggggagcaaacaggattagataccctggtagtccacgctgtaaacgatgaatactaggtgtcgg<br>gtggcaaagccattcggtgccgcagcaaacgcaataagtattccacctggggagtacgttcgcaagaatgaaactcaaagga<br>attgacggggacccgcacaagcggtggagcatgtggtttaattcgaagcaacgcgaagaaccttaccaaatcttgacatccct<br>ctgaccgggaagtaatgttcccttttcttcggaacagaggagacaggtggtgcatggttgtcgtcagctcgtgtcgtgagatgtt<br>gggttaagtcccgcaacgagcgcaacccttattcttagtagccagcaggtagagctgggcactctagggagactgccaggga<br>taacctggaggaaggtggggatgacgtcaaatcatcatgccccttatgatttgggctacacacgtgctacaatggcgtaaacaa<br>agggaagcgaaggggtgacctggagcaaatctcaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gtcagtaacgcccgaagtcagtgacccaaccgaaaggagggagctgccgaaggtgggactgataactggggtgaagtcgt<br>aacaaggtagccgtatcggaaggtgcggctggatcacctccttt |
| *Holdemania_filiformis* | SEQ ID NO: 102 | acctaggcgatgatacgtagccgacctgagagggtgaccggccacattgggactgagacacggcccaaactcctacggga<br>ggcagcagtagggaattttcggcaatgggcgaaagcctgaccgagcaacgccgcgtgagtgaagaaggccttcgggttgta<br>aagctctgttgtgaaggaagaacggctcatacagggaatggtatgggagtgacggtactttaccagaaagccacggctaacta<br>cgtgccagcagccgcggtaatacgtaggtggcgagcgttatccggaattattgggcgtaaagggtgcgcaggcggtttgttaa<br>gtttaaggtgaaagcgtggggcttaaccccatatagccttagaaactgacagactagagtacaggagagggcaatggaattcc<br>atgtgtagcggtaaaatgcgtagatatatggaggaacaccagtggcgaaggcggttgcctggcctgtaactgacgctcatgca<br>cgaaagcgtggggagcaaataggattagataccctagtagtccacgccgtaaacgatgagaactaagtgttggggaaactca<br>gtgctgcagttaacgcaataagttctccgcctggggagtatgcacgcaagtgtgaaactcaaaggaattgacgggggcccgc<br>acaagcggtggagtatgtggtttaattcgacgcaacgcgaagaaccttaccaggtcttgacatcccctgcaaagacatagagat<br>atgttggaggttatcagggagacaggtggtgcatggttgtcgtcagctcgtgtcgtgagatgttgggttaagtcccgcaacgag<br>cgcaacccttgtctttagttgctaacattaagttgaggactctagagagactgccggtgacaaaccggaggaaggtggggatg<br>acgtcaaatcatcatgccccttatgacctgggctacacacgtactacaatggcggatacaacgagaagcaagacagtgatgtg<br>gagcaaaactcagaaagtccgtctcagttcggattgaagtctgcaacccgacttcatgaagccggaatcgctagtaatcgcgg<br>atcagcatgccgcggtgaatacgttctcgggccttgtacacaccgcccgtcaaaccatgagagttggcaatacccgaagccgg<br>tggcctaacctcgcaagaggagggagccgtcgaaggtagggctgatgattggggttaagtcgtaacaaggtatccctacggg<br>aacgtggggatggatcacctccttt |

TABLE 5-continued

Full length 16S rDNA sequences of species (negative correlates)

| Species Name | Sequence Identifier | 16S rDNA sequence |
| --- | --- | --- |
| *Clostridium _asparagiforme* | SEQ ID NO: 103 | tttgagagtttgatcctggctcaggatgaacgctggcggcgtgcctaacacatgcaagtcgaacgaagcattttagatgaagtttt cggatggattctgagatgactgagtggcggacgggtgagtaacacgtggataacctgcctcacactgggggacaacagttag aaatgactgctaataccgcataagcgcacagtaccgcatggtacggtgtgaaaaactccggtggtgtgagatggatccgcgtc tgattagccagttggcggggtaacggcccaccaaagcgacgatcagtagccgacctgagagggtgaccggccacattggga ctgagacacggcccaaactcctacgggaggcagcagtggggaatattgcacaatgggcgaaagcctgatgcagcgacgcc gcgtgagtgaagaagtatttcggtatgtaaagctctatcagcagggaagataatgacggtacctgactaagaagccccggcta actacgtgccagcagccgcggtaatacgtagggggcaagcgttatccggatttactgggtgtaaagggagcgtagacggcat ggcaagtctgaagtgaaaacccagggctcaaccctgggactgctttggaaactgtcaagctagagtgcaggagaggtaagtg gaattcctagtgtagcggtgaaatgcgtagatattaggaggaacaccagtggcgaaggcggcttactggactgtaactgacgtt gaggctcgaaagcgtggggagcaaacaggattagataccctggtagtccacgccgtaaacgatgagtgctaggtgttgggg ggcaaagcccttcggtgccgtcgcaaacgcaataagcactccacctggggagtacgttcgcaagaatgaaactcaaaggaat tgacggggacccgcacaagcggtggagcatgtggtttaattcgaagcaacgcgaagaaccttaccaagtcttgacatccccct gaccggcgtgtaacggcgcctttccttcgggacaggggagacaggtggtgcatggttgtcgtcagctcgtgtcgtgagatgtt gggttaagtcccgcaacgagcgcaacccttatccttagtagccagcattaagatgggcactctagggagactgccagggaca acctggaggaaggtggggatgacgtcaaatcatcatgccccttatgatttgggctacacacgtgctacaatggcgtaaacaaa gggaagcgaccctgcgaaggtgagcaaatctcaaaaataacgtcccagttcggactgtagtctgcaacccgactacacgaag ctggaatcgctagtaatcgcgaatcagaatgtcgcggtgaatacgttcccgggtcttgtacacaccgcccgtcacaccatgga gtcagcaacgcccgaagtcagtgacccaaccgaaaggagggagctgccgaaggcggggcaggtaactggggtgaagtcg taacaaggtagccgtatcggaaggtgcggctggatcacctccttt |
| *Blautia_wexlerae* | SEQ ID NO: 104 | tcagagagtttgatcctggctcaggatgaacgctggcggcgtgcttaacacatgcaagtcgaacgggaattactttattgaaact tcggtcgatttaatttaattctagtggcggacgggtgagtaacgcgtgggtaacctgccttatacagggggataacagtcagaaa tggctgctaataccgcataagcgcacagagctgcatggctcagtgtgaaaaactccggtggtataagatggacccgcgttgga ttagctagttggtggggtaacggcccaccaaggcgacgatccatagccggcctgagagggtgaacggccacattgggactg agacacggcccagactcctacgggaggcagcagtggggaatattgcacaatgggggaaaccctgatgcagcgacgccgc gtgaaggaagaagtatctcggtatgtaaacttctatcagcagggaagatagtgacggtacctgactaagaagccccggctaac tacgtgccagcagccgcggtaatacgtagggggcaagcgttatccggatttactgggtgtaaagggagcgtagacggtgtgg caagtctgatgtgaaaggcatgggctcaacctgtggactgcattggaaactgtcatacttgagtgccggaggggtaagcggaa ttcctagtgtagcggtgaaatgcgtagatattaggaggaacaccagtggcgaaggcggcttactggacggtaactgacgttga ggctcgaaagcgtggggagcaaacaggattagataccctggtagtccacgccgtaaacgatgaatactaggtgtcgggtggc agagccattcggtgccgtcgcaaacgcagtaagtattccacctggggagtacgttcgcaagaatgaaactcaaaggaattgac ggggacccgcacaagcggtggagcatgtggtttaattcgaagcaacgcgaagaaccttaccaagtcttgacatccgcctgact gatccttaaccggatctttccttcgggacaggcgagacaggtggtgcatggttgtcgtcagctcgtgtcgtgagatgttgggtta agtcccgcaacgagcgcaacccctatcctcagtagccagcatttaaggtgggcactctggggagactgccagggataacctg gaggaaggcggggatgacgtcaaatcatcatgccccttatgatttgggctacacacgtgctacaatggcgtaaacaaagggaa gcgagattgtgagatggagcaaatcccaaaaataacgtcccagttcggactgtagtctgcaacccgactacacgaagctggaa tcgctagtaatcgcggatcagaatgccgcggtgaatacgttcccgggtcttgtacacaccgcccgtcacaccatggggagtca gtaacgcccgaagtcagtgacctaaccgaaagggaggagctgccgaaggcgggaccgatgactggggtgaagtcgtaaca aggtagccgtatcggaaggtgcggctggatcacctccttt |
| *Blautia_wexlerae* | SEQ ID NO: 105 | cagagagtttgatcctggctcaggatgaacgctggcggcgtgcttaacacatgcaagtcgaacgggaattactttattgaaactt cggtcgatttaatttaattctagtggcggacgggtgagtaacgcgtgggtaacctgccttatacagggggataacagtcagaaat ggctgctaataccgcataagcgcacagagctgcatggctcagtgtgaaaaactccggtggtataagatggacccgcgttggat tagctagttggtggggtaacggcccaccaaggcgacgatccatagccggcctgagagggtgaacggccacattgggactga gacacggcccagactcctacgggaggcagcagtggggaatattgcacaatgggggaaaccctgatgcagcgacgccgcgt gaaggaagaagtatctcggtatgtaaacttctatcagcagggaagatagtgacggtacctgactaagaagccccggctaacta cgtgccagcagccgcggtaatacgtagggggcaagcgttatccggatttactgggtgtaaagggagcgtagacggtgtggca |

TABLE 5-continued

Full length 16S rDNA sequences of species (negative correlates)

| Species Name | Sequence Identifier | 16S rDNA sequence |
|---|---|---|
| | | agtctgatgtgaaaggcatgggctcaacctgtggactgcattggaaactgtcatacttgagtgccggaggggtaagcggaattc<br>ctagtgtagcggtgaaatgcgtagatattaggaggaacaccagtggcgaaggcggcttactggacggtaactgacgttgagg<br>ctcgaaagcgtggggagcaaacaggattagataccctggtagtccacgccgtaaacgatgaatactaggtgtcggggagcat<br>ggctcttcggtgccgtcgcaaacgcagtaagtattccacctggggagtacgttcgcaagaatgaaactcaaaggaattgacgg<br>ggacccgcacaagcggtggagcatgtggtttaattcgaagcaacgcgaagaaccttaccaagtcttgacatccgcctgaccga<br>tccttaaccggatctttccttcgggacaggcgagacaggtggtgcatggttgtcgtcagctcgtgtcgtgagatgttgggttaagt<br>cccgcaacgagcgcaacccctatcctcagtagccagcatttaaggtgggcactctggggagactgccagggataacctggag<br>gaaggcggggatgacgtcaaatcatcatgccccttatgatttgggctacacacgtgctacaatggcgtaaacaaagggaagcg<br>agattgtgagatggagcaaatcccaaaaataacgtcccagttcggactgtagtctgcaacccgactacacgaagctggaatcg<br>ctagtaatcgcggatcagaatgccgcggtgaatacgttcccgggtcttgtacacaccgcccgtcacaccatgggagtcagtaa<br>cgcccgaagtcagtgacctaactgcaaagaaggagctgccgaaggcgggaccgatgactggggtgaagtcgtaacaaggt<br>agccgtatcggaaggtgcggctggatcacctccttt |
| *Blautia_wexlerae* | SEQ ID NO: 106 | cagagagtttgatcctggctcaggatgaacgctggcggcgtgcttaacacatgcaagtcgaacgggaattactttattgaaactt<br>cggtcgatttaatttaattctagtggcggacgggtgagtaacgcgtgggtaacctgccttatacagggggataacagtcagaaat<br>ggctgctaataccgcataagcgcacagagctgcatggctcagtgtgaaaaactccggtggtataagatggacccgcgttggat<br>tagctggttggtggggtaacggcccaccaaggcgacgatccatagccggcctgagagggtgaacggccacattgggactga<br>gacacggcccagactcctacgggaggcagcagtggggaatattgcacaatgggggaaaccctgatgcagcgacgccgcgt<br>gaaggaagaagtatctcggtatgtaaacttctatcagcagggaagatagtgacggtacctgactaagaagccccggctaacta<br>cgtgccagcagccgcggtaatacgtagggggcaagcgttatccggatttactgggtgtaaagggagcgtagacggtgtggca<br>agtctgatgtgaaaggcatgggctcaacctgtggactgcattggaaactgtcatacttgagtgccggaggggtaagcggaattc<br>ctagtgtagcggtgaaatgcgtagatattaggaggaacaccagtggcgaaggcggcttactggacggtaactgacgttgagg<br>ctcgaaagcgtggggagcaaacaggattagataccctggtagtccacgccgtaaacgatgaatactaggtgtcgggtagcat<br>agctcttcggtgccgtcgcaaacgcagtaagtattccacctggggagtacgttcgcaagaatgaaactcaaaggaattgacgg<br>ggacccgcacaagcggtggagcatgtggtttaattcgaagcaacgcgaagaaccttaccaagtcttgacatccctctgaccga<br>aacttaatcggatctttccttcgggacagacgagacaggtggtgcatggttgtcgtcagctcgtgtcgtgagatgttgggttaagt<br>cccgcaacgagcgcaacccctatcctcagtagccagcatttaaggtgggcactctggggagactgccagggataacctggag<br>gaaggcggggatgacgtcaaatcatcatgccccttatgatttgggctacacacgtgctacaatggcgtaaacaaagggaagcg<br>agattgtgagatggagcaaatcccaaaaataacgtcccagttcggactgtagtctgcaacccgactacacgaagctggaatcg<br>ctagtaatcgcggatcagaatgccgcggtgaatacgttcccgggtcttgtacacaccgcccgtcacaccatgggagtcagtaa<br>cgcccgaagtcagtgacctaactgcaaagaaggagctgccgaaggcgggaccgatgactggggtgaagtcgtaacaaggt<br>agccgtatcggaaggtgcggctggatcacctccttt |
| *Blautia_wexlerae* | SEQ ID NO: 107 | tcagagagtttgatcctggctcaggatgaacgctggcggcgtgcttaacacatgcaagtcgaacgggaaatatttcattgagac<br>ttcggtggatttgatctatttctagtggcggacgggtgagtaacgcgtgggtaacctgccttatacagggggataacagtcagaa<br>atggctgctaataccgcataagcgcacagagctgcatggctcagtgtgaaaaactccggtggtataagatggacccgcgttgg<br>attagctggttggtggggtaacggcccaccaaggcgacgatccatagccggcctgagagggtgaacggccacattgggact<br>gagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggtgtg<br>gcaagtctgatgtgaaaggcatgggctcaacctgtggactgcattggaaactgtcatacttgagtgccggaggggtaagcgga<br>attcctagtgtagcggtgaaatgcgtagatattaggaggaacaccagtggcgaaggcggcttactggacggtaactgacgttg<br>aggctcgaaagcgtggggagcaaacaggattagataccctggtagtccacgccgtaaacgatgaatactaggtgtcgggga<br>gcatggctcttcggtgccgtcgcaaacgcagtaagtattccacctggggagtacgttcgcaagaatgaaactcaaaggaattg<br>acggggacccgcacaagcggtggagcatgtggtttaattcgaagcaacgcgaagaaccttaccaagtcttgacatccgcctg<br>accgatccttaaccggatctttccttcgggacaggcgagacaggtggtgcatggttgtcgtcagctcgtgtcgtgagatgttggg<br>ttaagtcccgcaacgagcgcaacccctatcctcagtagccagcatttaaggtgggcactctggggagactgccagggataacc<br>tggaggaaggcggggatgacgtcaaatcatcatgccccttatgatttgggctacacacgtgctacaatggcgtaaacaaaggg |

TABLE 5-continued

| Full length 16S rDNA sequences of species (negative correlates) | | |
|---|---|---|
| Species Name | Sequence Identifier | 16S rDNA sequence |
| | | aagcgagattgtgagatggagcaaatcccaaaaataacgtcccagttcggactgtagtctgcaacccgactacacgaagctgg<br>aa |
| *Blautia_wex lerae.* | SEQ ID NO: 108 | cagagagtttgatcctggctcaggatgaacgctggcggcgtgcttaacacatgcaagtcgaacgggaattactttattgaaactt<br>cggtcgatttaatttaattctagtggcggacgggtgagtaacgcgtgggtaacctgccttatacaggggggataacagtcagaaat<br>ggctgctaataccgcataagcgcacagagctgcatggctcagtgtgaaaaactccggtggtataagatggacccgcgttggat<br>tagctagttggtggggtaacggcccaccaaggcgacgatccatagccggcctgagagggtgaacggccacattgggactga<br>gacacggcccagactcctacgggaggcagcagtggggaatattgcacaatgggggaaaccctgatgcagcgacgccgcgt<br>gaaggaagaagtatctcggtatgtaaacttctatcagcagggaagatagtgacggtacctgactaagaagccccggctaacta<br>cgtgccagcagccgcggtaatacgtagggggcaagcgttatccggatttactgggtgtaaagggagcgtagacggtgtggca<br>agtctgatgtgaaaggcatgggctcaacctgtggactgcattggaaactgtcatacttgagtgccggaggggtaagcggaattc<br>ctagtgtagcggtgaaatgcgtagatattaggaggaacaccagtggcgaaggcggcttactggacggtaactgacgttgttgg<br>ctcgaaagcgtggggagcaaacaggattagataccctggtagtccacgccgtaaacgatgaatactaggtgtcggggagcat<br>ggctcttcggtgccgtcgcaaacgcagtaagtattccacctggggagtacgttcgcaagaatgaaactcaaaggaattgacgg<br>ggacccgcacaagcggtggagcatgtggtttaattcgaagcaacgcgaagaaccttaccaagtcttgacatccgcctgaccga<br>tccttaaccggatctttccttcgggacaggcgagacaggtggtgcatggttgtcgtcagctcgtgtcgtgagatgttgggttaagt<br>cccgcaacgagcgcaacccctatcctcagtagccagcatttaaggtgggcactctggggagactgccagggataacctggag<br>gaaggcggggatgacgtcaaatcatcatgccccttatgatttgggctacacacgtgctacaatggcgtaaacaaagggaagcg<br>agattgtgagatggagcaaatcccaaaaataacgtcccagttcggactgtagtctgcaacccgactacacgaagctggaatcg<br>ctagtaatcgcggatcagaatgccgcggtgaatacgttcccgggtcttgtacacaccgcccgtcacaccatgggagtcagtaa<br>cgcccgaagtcagtgacctaactgcaaagaaggagctgccgaaggcgggaccgatgactggggtgaagtcgtaacaaggt<br>agccgtatcggaaggtgcggctggatcacctccttt |
| *Blautia_wex lerae* | SEQ ID NO: 109 | tcagagagtttgatcctggctcaggatgaacgctggcggcgtgcttaacacatgcaagtcgaacgggaattactttattgaaact<br>tcggtcgatttaatttaattctagtggcggacgggtgagtaacgcgtgggtaacctgccttatacaggggggataacagtcagaaa<br>tggctgctaataccgcataagcgcacagagagcatgctcagtgtgaaaaactccggtggtataagatggacccgcgttgga<br>ttagcttgttggtgaggtaacggcccaccaaggcgacgatccatagccggcctgagagggtgaacggccacattgggactga<br>gacacggcccagactcctacgggaggcagcagtggggaatattgcacaatgggggaaaccctgatgcagcgacgccgcgt<br>gaaggaagaagtatctcggtatgtaaacttctatcagcagggaagatagtgacggtacctgactaagaagccccggctaacta<br>cgtgccagcagccgcggtaatacgtagggggcaagcgttatccggatttactgggtgtaaagggagcgtagacggtgtggca<br>agtctgatgtgaaaggcatgggctcaacctgtggactgcattggaaactgtcatacttgagtgccggaggggtaagcggaattc<br>ctagtgtagcggtgaaatgcgtagatattaggaggaacaccagtggcgaaggcggcttactggacggtaactgacgttgagg<br>ctcgaaagcgtggggagcaaacaggattagataccctggtagtccacgccgtaaacgatgaatactaggtgtcggggagcat<br>ggctcttcggtgccgtcgcaaacgcagtaagtattccacctggggagtacgttcgcaagaatgaaactcaaaggaattgacgg<br>ggacccgcacaagcggtggagcatgtggtttaattcgaagcaacgcgaagaaccttaccaagtcttgacatccctctgaccgg<br>aacttaatcgttcctttccttcgggacagaggagacaggtggtgcatggttgtcgtcagctcgtgtcgtgagatgttgggttaagt<br>cccgcaacgagcgcaacccctatcctcagtagccagcatttaaggtgggcactctggggagactgccagggataacctggag<br>gaaggcggggatgacgtcaaatcatcatgccccttatgatttgggctacacacgtgctacaatggcgtaaacaaagggaagcg<br>agattgtgagatggagcaaatcccaaaaataacgtcccagttcggactgtagtctgcaacccgactacacgaagctggaatcg<br>ctagtaatcgcggatcagaatgccgcggtgaatacgttcccgggtcttgtacacaccgcccgtcacaccatgggagtcagtaa<br>cgcccgaagtcagtgacctaactgcaaagaaggagctgccgaaggcgggaccgatgactggggtgaagtcgtaacaaggt<br>agccgtatcggaaggtgcggctggatcacctccttt |
| *Blautia_wex lerae* | SEQ ID NO: 110 | tcagagagtttgatcctggctcaggatgaacgctggcggcgtgcttaacacatgcaagtcgaacgggaaatatttcattgagac<br>ttcggtggatttgatctatttctagtggcggacgggtgagtaacgcgtgggtaacctgccttatacaggggggataacagtcagaa<br>atggctgctaataccgcataagcgcacagagctgcatggctcagtgtgaaaaactccggtggtataagatggacccgcgttgg<br>attagctggttggtggggtaacggcccaccaaggcgacgatccatagccggcctgagagggtgaacggccacattgggact<br>gagacacggcccagactcctacgggaggcagcagtggggaatattgcacaatgggggaaaccctgatgcagcgacgccg |

TABLE 5-continued

Full length 16S rDNA sequences of species (negative correlates)

| Species Name | Sequence Identifier | 16S rDNA sequence |
| --- | --- | --- |
| | | cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggtgtg<br>gcaagtctgatgtgaaaggcatgggctcaacctgtggactgcattggaaactgtcatacttgagtgccggaggggtaagcgga<br>attcctagtgtagcggtgaaatgcgtagatattaggaggaacaccagtggcgaaggcggcttactggacggtaactgacgttg<br>aggctcgaaagcgtggggagcaaacaggattagataccctggtagtccacgccgtaaacgatgaatactaggtgtcgggtgg<br>cagagccattcggtgccgtcgcaaacgcagtaagtattccacctggggagtacgttcgcaagaatgaaactcaaaggaattga<br>cggggacccgcacaagcggtggagcatgtggtttaattcgaagcaacgcgaagaaccttaccaagtcttgacatccctctgac<br>cggaacttaatcgttcctttccttcgggacagaggagacaggtggtgcatggttgtcgtcagctcgtgtcgtgagatgttgggtta<br>agtcccgcaacgagcgcaacccctatcctcagtagccagcatttaaggtgggcactctggggagactgccagggataacctg<br>gaggaaggcggggatgacgtcaaatcatcatgccccttatgatttgggctacacacgtgctacaatggcgtaaacaaagggaa<br>gcgagattgtgagatggagcaaatcccaaaaataacgtcccagttcggactgtagtctgcaacccgactacacgaagctggaa<br>tcgctagtaatcgcggatcagaatgccgcggtgaatacgttcccgggtcttgtacacaccgcccgtcacaccatgggagtcag<br>taacgcccgaagtcagtgacctaactgcaaagaaggagctgecgaaggcgggaccgatgactggggtgaagtcgtaacaa<br>ggtagccgtatcggaaggtgcggctggatcacctccttt |
| *Dialister_in visus* | SEQ ID NO: 111 | atggagagtttgatcctggctcaggacgaacgctggcggcgtgcttaacacatgcaagtcgaacgaaaagacggaaagagct<br>tgctcttttcagaattgagtggcaaacgggtgagtaacacgtaaacaacctgccttcaggatggggacaacagacggaaacga<br>ctgctaataccgaataagttccaagagccgcatggcccatggaagaaaaggtggcctctacctgtaagctatcgcctgaagag<br>gggtttgcgtctgattagaggttggaggggtaacggcccaccaaggcgacgatcagtagccggtctgagaggatgaacgge<br>cacactggaactgagacacggtccagactcctacgggaggcagcagtggggaatcttccgcaatgggcgaaagcctgacg<br>gage aacgccgcgtgagtgatgacggccttcgggttgtaaaactctgtgatccgggacgaaaaggcagagtgcgaagaaca<br>aactgcattgacggtaccggaaaagcaagccacggctaactacgtgccagcagccgcggtaatacgtaggtggcaagcgtt<br>gtccggaattattgggcgtaaagcgcgcgcaggcggcttcccaagtccctcttaaaagtgcggggcttaaccccgtgatggga<br>aggaaactgggaagctggagtatcggagaggaaagtggaattcctagtgtagcggtgaaatgcgtagagattaggaagaac<br>accggtggcgaaggcgactttctggacgaaaactgacgctgaggcgcgaaagcgtggggagcaaacaggattagataccct<br>ggtagtccacgccgtaaacgatggatactaggtgtaggaggtatcgacccctcctgtgccggagttaacgcaataagtatccc<br>gcctgggaagtacgatcgcaagattaaaactcaaaggaattgacggggcccgcacaagcggtggagtatgtggtttaattcga<br>cgcaacgcgaagaaccttaccaggtcttgacattgatcgcgatctgcagaaatgcggagttcttcttcggaagacgagaaaac<br>aggtggtgcacggctgtcgtcagctcgtgtcgtgagatgttgggttaagtcccgcaacgagcgcaacccctatcatttgttacca<br>gcacgtaaaggtggggactcaaatgagaccgccgcggacaacgcggaggaaggcggggacgacgtcaagtcatcatgcc<br>ccttatgacctgggctacacacgtactacaatgggtgtcaacaaagagaagcgaacccgcgaggaagagcaaacctcaaaa<br>acacacccccagttcagatcgcaggctgcaacccgcctgcgtgaagtaggaatcgctagtaatcgcgggtcagcataccgcg<br>gtgaatacgttcccgggccttgtacacaccgcccgtcacactatgagagtcagaaacacccgaagccggtgaggtaaccgca<br>aggagccagccgtcgaaggcggagctgatgattggagtgaagtcgtaacaaggtagccgtatcggaaggtgcggctggatc<br>acctccttt |
| *Dialister_in* visus | SEQ ID NO: 112 | atggagagtttgatcctggctcaggacgaacgctggcggcgtgcttaacacatgcaagtcgaacgaaaagagggaaagagc<br>ttgctctttccggaattgagtggcaaacgggtgagtaacacgtaaacaacctgccttcaggatggggacaacagacggaaacg<br>actgctaataccgaataagttccaagagccgcatggcccatggaagaaaaggtggcctctacctgtaagctatcgcctgaaga<br>ggggtttgcgtctgattagctggttggaggggtaacggcccaccaaggcgacgatcagtagccggtctgagaggatgaacg<br>gccacactggaactgagacacggtccagactcctacgggaggcagcagtggggaatcttccgcaatgggcgaaagcctga<br>cggagcaacgccgcgtgagtgatgacggccttcgggttgtaaaactctgtgatccgggacgaaaaggcagagtgcgaagaa<br>caaactgcattgacggtaccggaaaagcaagccacggctaactacgtgccagcagccgcggtaatacgtaggtggcaagcg<br>ttgtccggaattattgggcgtaaagcgcgcgcaggcggcttcccaagtccctcttaaaagtgcggggcttaaccccgtgatgg<br>gaaggaaactgggaagctggagtatcggagaggaaagtggaattcctagtgtagcggtgaaatgcgtagagattaggaaga<br>acaccggtggcgaaggcgactttctggacgaaaactgacgctgaggcgcgaaagcgtggggagcaaacaggattagatac<br>cctggtagtccacgccgtaaacgatggatactaggtgtaggaggtatcgacccctcctgtgccggagttaacgcaataagtatc<br>ccgcctgggaagtacgatcgcaagattaaaactcaaaggaattgacgggggcccgcacaagcggtggagtatgtggtttaatt |

TABLE 5-continued

Full length 16S rDNA sequences of species (negative correlates)

| Species Name | Sequence Identifier | 16S rDNA sequence |
|---|---|---|
| | | cgacgcaacgcgaagaaccttaccaggtcttgacattgatcgcgatctgcagaaatgcggagttcttcttcggaagacgagaa<br>aacaggtggtgcacggctgtcgtcagctcgtgtcgtgagatgttgggttaagtcccgcaacgagcgcaacccctatcatttgtta<br>ccagcacgtaaaggtggggactcaaatgagaccgccgcggacaacgcggaggaaggcggggacgacgtcaagtcatcat<br>gccccttatgacctgggctacacacgtactacaatgggtgtcaacaaagagaagcgaacccgcgaggaagagcaaacctca<br>aaaacacacccccagttcagatcgcaggctgcaacccgcctgcgtgaagtaggaatcgctagtaatcgcgggtcagcatacc<br>gcggtgaatacgttcccgggccttgtacacaccgcccgtcacactatgagagtcagaaacacccgaagccggtgaggtaacc<br>gcaaggagccagccgtcgaaggcggagctgatgattggagtgaagtcgtaacaaggtagccgtatcggaaggtgcggctg<br>gatcacctccttt |
| *Dialister_invisus* | SEQ ID NO: 113 | atggagagtttgatcctggctcaggacgaacgctggcggcgtgcttaacacatgcaagtcgaacgaaaagacggaaagagct<br>tgctcttttcagaattgagtggcaaacgggtgagtaacacgtaaacaacctgccttcaggatggggacaacagacggaaacga<br>ctgctaatgccgaataagttccaagagccgcatggcccatggaagaaaaggtggcctctacctgtaagctatcgcctgaagag<br>gggtttgcgtctgattagctggttggaggggtaacggcccaccaaggcgacgatcagtagccggtctgagaggatgaacggc<br>cacactggaactgagacacggtccagactcctacgggaggcagcagtggggaatcttccgcaatgggcgaaagcctgacg<br>gagcaacgccgcgtgagtgatgacggccttcgggttgtaaaactctgtgatccgggacgaaaaggcagagtgcgaagaaca<br>aactgcattgacggtaccggaaaagcaagccacggctaactacgtgccagcagccgcggtaatacgtaggtggcaagcgtt<br>gtccggaattattgggcgtaaagcgcgcgcaggcggcttcccaagtccctcttaaaagtgcggggcttaaccccgtgatggga<br>aggaaactgggaagctggagtatcggagaggaaagtggaattcctagtgtagcggtgaaatgcgtagagattaggaagaac<br>accggtggcgaaggcgactttctggacgaaaactgacgctgaggcgcgaaagcgtggggagcaaacaggattagataccct<br>ggtagtccacgccgtaaacgatggatactaggtgtaggaggtatcgacccctcctgtgccggagttaacgcaataagtatccc<br>gcctgggaagtacgatcgcaagattaaaactcaaaggaattgacgggggcccgcacaagcggtggagtatgtggtttaattcg<br>acgcaacgcgaagaaccttaccaggtcttgacattgatcgcgatctgcagaaatgcggagttcttcttcggaagacgagaaaa<br>caggtggtgcacggctgtcgtcagctcgtgtcgtgagatgttgggttaagtcccgcaacgagcgcaacccctatcatttgttacc<br>agcacgtaaaggtggggactcaaatgagaccgccgcggacaacgcggaggaaggcggggacgacgtcaagtcatcatgc<br>cccttatgacctgggctacacacgtactacaatgggtgtcaacaaagagaagcgaacccgcgaggaagagcaaacctcaaa<br>aacacacccccagttcagatcgcaggctgcaacccgcctgcgtgaagtaggaatcgctagtaatcgcgggtcagcataccgc<br>ggtgaatacgttcccgggccttgtacacaccgcccgtcacactatgagagtcagaaacacccgaagccggtgaggtaaccgc<br>aaggagccagccgtcgaaggcggagctgatgattggagtgaagtcgtaacaaggtagccgtatcggaaggtgcggctggat<br>cacctccttt |
| *Dorea_formicigenerans* | SEQ ID NO: 114 | acgagagtttgatcctggctcaggatgaacgctggcggcgtgcttaacacatgcaagtcgagcgaagcacataagttcgattct<br>tcggatgaagacttttgtgactgagcggcggacgggtgagtaacgcgtgggtaacctgcctcatacagggggataacagcta<br>gaaatggctgctaataccgcataagaccacagtactgcatggtacagtggtaaaaactccggtggtatgagatggacccgcgt<br>ctgattaggtagttggtgaggtaacggcccaccaagccgacgatcagtagccgacctgagagggtgaccggccacattggg<br>actgagacacggcccagactcctacgggaggcagcagtggggaatattgcacaatgggcgaaagcctgatgcagcgacgc<br>cgcgtgaaggatgaagtatttcggtatgtaaacttctatcagcagggaagaaaatgacggtacctgactaagaagccccggct<br>aactacgtgccagcagccgcggtaatacgtagggggcaagcgttatccggatttactgggtgtaaagggagcgtagacggct<br>gtgcaagtctgaagtgaaaggcatgggctcaacctgtggactgctttggaaactgtgcagctagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgactgctaggtgtcgggt<br>agcaaagctattcggtgccgcagctaacgcaataagcagtccacctggggagtacgttcgcaagaatgaaactcaaaggaatt<br>gacggggacccgcacaagcggtggagcatgtggtttaattcgaagcaacgcgaagaaccttacctgatcttgacatcccgatg<br>accgcttcgtaatggaagtttttcttcggaacatcggtgacaggtggtgcatggttgtcgtcagctcgtgtcgtgagatgttgggtt<br>aagtcccgcaacgagcgcaacccttatcttcagtagccagcattaaggatgggcactctggagagactgccagggataacctg<br>gaggaaggtggggatgacgtcaaatcatcatgccccttatgaccagggctacacacgtgctacaatggcgtaaacaaaggga<br>ggcagagccgcgaggccgagcaaatctcaaaaataacgtctcagttcggattgtagtctgcaactcgactacatgaagctgga<br>atcgctagtaatcgcagatcagaatgctgcggtgaatacgttcccgggtcttgtacacaccgcccgtcacaccatgggagtcag |

TABLE 5-continued

| Full length 16S rDNA sequences of species (negative correlates) | | |
|---|---|---|
| Species Name | Sequence Identifier | 16S rDNA sequence |
| | | taacgcccgaagtcagtgacccaaccgaaaggagggagctgccgaaggtgggaccgataactggggtgaagtcgtaacaa ggtagccgtatcggaaggtgcggctggatcacctccttt |
| *Dorea_formicigenerans* | SEQ ID NO: 115 | acgagagtttgatcctggctcaggatgaacgctggcggcgtgcttaacacatgcaagtcgagcgaagcacttaagtttgattctt cggatgaagacttttgtgactgagcggcggacgggtgagtaacgcgtgggtaacctgcctcatacagggggataacagttag aaatggctgctaataccgcataagaccacagtactgcatggtacagtggtaaaaactccggtggtatgagatggacccgcgtct gattaggtagttggtgaggtaacggcccaccaagccgacgatcagtagccgacctgagagggtgaccggccacattgggac tgagacacggcccagactcctacgggaggcagcagtggggaatattgcacaatgggcgaaagcctgatgcagcgacgccg cgtgaaggatgaagtatttcggtatgtaaacttctatcagcagggaagaaaatgacggtacctgactaagaagccccggctaac tacgtgccagcagccgcggtaatacgtagggggcaagcgttatccggatttactgggtgtaaagggagcgtagacggctgtg caagtctgaagtgaaaggcatgggctcaacctgtggactgctttggaaactgtgcagctagagtgtcggagaggtaagtggaa ttcctagtgtagcggtgaaatgcgtagatattaggaggaacaccagtggcgaaggcggcttactggacgatgactgacgttga ggctcgaaagcgtggggagcaaacaggattagataccctggtagtccacgccgtaaacgatgactgctaggtgtcgggtagc aaagctattcggtgccgcagctaacgcaataagcagtccacctggggagtacgttcgcaagaatgaaactcaaaggaattgac ggggacccgcacaagcggtggagcatgtggtttaattcgaagcaacgcgaagaaccttacctgatcttgacatcccgatgacc gatcgtaatggaagcttttcttcggaacatcggtgacaggtggtgcatggttgtcgtcagctcgtgtcgtgagatgttgggttaa gtcccgcaacgagcgcaacccttatcttcagtagccagcattaaggatgggcactctggagagactgccagggataacctgg aggaaggtggggatgacgtcaaatcatcatgccccttatgaccagggctacacacgtgctacaatggcgtaaacaaagggaa gcagagccgcgaggccgagcaaatctcaaaaataacgtctcagttcggattgtagtctgcaactcgactacatgaagctggaa tcgctagtaatcgcagatcagaatgctgcggtgaatacgttcccgggtcttgtacacaccgcccgtcacaccatgggagtcagt aacgcccgaagtcagtgacccaaccgaaaggagggagctgccgaaggtgggaccgataactggggtgaagtcgtaacaa ggtagccgtatcggaaggtgcggctggatcacctccttt |
| *Dorea_formicigenerans* | SEQ ID NO: 116 | acgagagtttgatcctggctcaggatgaacgctggcggcgtgcttaacacatgcaagtcgagcgaagcacttaagtttgattctt cggatgaagacttttgtgactgagcggcggacgggtgagtaacgcgtgggtaacctgcctcatacagggggataacagttag aaatggctgctaataccgcataagaccacagtactgcatggtacagtggtaaaaactccggtggtatgagatggacccgcgtct gattaggtagttggtgaggtaacggcccaccaagccgacgatcagtagccgacctgagagggtgaccggccacattgggac tgagacacggcccagactcctacgggaggcagcagtggggaatattgcacaatgggcgaaagcctgatgcagcgacgccg cgtgaaggatgaagtatttcggtatgtaaacttctatcagcagggaagaaaatgacggtacctgactaagaagccccggctaac tacgtgccagcagccgcggtaatacgtagggggcaagcgttatccggatttactgggtgtaaagggagcgtagacggctgtg caagtctgaagtgaaaggcatgggctcaacctgtggactgctttggaaactgtgcagctagagtgtcggagaggtaagtggaa ttcctagtgtagcggtgaaatgcgtagatattaggaggaacaccagtggcgaaggcggcttactggacgatgactgacgttga ggctcgaaagcgtggggagcaaacaggattagataccctggtagtccacgccgtaaacgatgactgctaggtgtcgggtagc aaagctattcggtgccgcagctaacgcaataagcagtccacctggggagtacgttcgcaagaatgaaactcaaaggaattgac ggggacccgcacaagcggtggagcatgtggtttaattcgaagcaacgcgaagaaccttacctgatcttgacatcccgatgacc gcttcgtaatggaagtttttcttcggaacatcggtgacaggtggtgcatggttgtcgtcagctcgtgtcgtgagatgttgggttaag tcccgcaacgagcgcaacccttatattcagtagccagcatttaggatgggcactctggagagactgccagggataacctggag gaaggtggggatgacgtcaaatcatcatgccccttatgaccagggctacacacgtgctacaatggcgtaaacaaagggaggc agagccgcgaggccgagcaaatctcaaaaataacgtctcagttcggattgtagtctgcaactcgactacatgaagctggaatc gctagtaatcgcagatcagaatgctgcggtgaatacgttcccgggtcttgtacacaccgcccgtcacaccatgggagtcagtaa cgcccgaagtcagtgacccaaccgaaaggagggagctgccgaaggtgggaccgataactggggtgaagtcgtaacaaggt agccgtatcggaaggtgcggctggatcacctccttt |
| *Dorea_formicigenerans* | SEQ ID NO: 117 | acgagagtttgatcctggctcaggatgaacgctggcggcgtgcttaacacatgcaagtcgagcgaagcacttaagtttgattctt cggatgaagacttttgtgactgagcggcggacgggtgagtaacgcgtgggtaacctgcctcatacagggggataacagttag aaatggctgctaataccgcataagaccacagtactgcatggtacagtggtaaaaactccggtggtatgagatggacccgcgtct gattaggtagttggtgaggtaacggcccaccaagccgacgatcagtagccgacctgagagggtgaccggccacattgggac tgagacacggcccagactcctacgggaggcagcagtggggaatattgcacaatgggcgaaagcctgatgcagcgacgccg |

TABLE 5-continued

Full length 16S rDNA sequences of species (negative correlates)

| Species Name | Sequence Identifier | 16S rDNA sequence |
|---|---|---|
| | | cgtgaaggatgaagtatttcggtatgtaaacttctatcagcagggaagaaaatgacggtacctgactaagaagccccggctaac<br>tacgtgccagcagccgcggtaatacgtagggggcaagcgttatccggatttactgggtgtaaagggagcgtagacggctgtg<br>caagtctgaagtgaaaggcatgggctcaacctgtggactgctttggaaactgtgcagctagagtgtcggagaggtaagtggaa<br>ttcctagtgtagcggtgaaatgcgtagatattaggaggaacaccagtggcgaaggcggcttactggacgatgactgacgttga<br>ggctcgaaagcgtggggagcaaacaggattagataccctggtagtccacgccgtaaacgatgactgctaggtgtcgggtagc<br>aaagctattcggtgccgcagctaacgcaataagcagtccacctggggagtacgttcgcaagaatgaaactcaaaggaattgac<br>ggggacccgcacaagcggtggagcatgtggtttaattcgaagcaacgcgaagaaccttacctgatcttgacatcccgatgacc<br>gcttcgtaatggaagcttttcttcggaacatcggtgacaggtggtgcatggttgtcgtcagctcgtgtcgtgagatgttgggttaa<br>gtcccgcaacgagcgcaacccttatcttcagtagccagcatttaggatgggcactctggagagactgccagggataacctgga<br>ggaaggtggggatgacgtcaaatcatcatgccccttatgaccagggctacacacgtgctacaatggcgtaaacaaagggagg<br>cagagccgcgaggccgagcaaatctcaaaaataacgtctcagttcggattgtagtctgcaactcgactacatgaagctggaatc<br>gctagtaatcgcagatcagaatgctgcggtgaatacgttcccgggtcttgtacacaccgcccgtcacaccatgggagtcagtaa<br>cgcccgaagtcagtgacccaaccgaaaggagggagctgccgaaggtgggaccgataactggggtgaagtcgtaacaaggt<br>agccgtatcggaaggtgcggctggatcacctccttt |
| *Dorea_formicigenerans* | SEQ ID NO: 118 | tatgagatggacccgcgtctgattaggtagttggtgaggtaacggcccaccaagccgacgatcagtagccgacctgagaggg<br>tgaccggccacattgggactgagacacggcccagactcctacgggaggcagcagtggggaatattgcacaatgggcgaaa<br>gcctgatgcagcgacgccgcgtgaaggatgaagtatttcggtatgtaaacttctatcagcagggaagaaaatgacggtacctg<br>actaagaagccccggctaactacgtgccagcagccgcggtaatacgtagggggcaagcgttatccggatttactgggtgtaa<br>agggagcgtagacggctgtgcaagtctgaagtgaaaggcatgggctcaacctgtggactgctttggaaactgtgcagctaga<br>gtgtcggagaggtaagtggaattcctagtgtagcggtgaaatgcgtagatattaggaggaacaccagtggcgaaggcggctt<br>actggacgatgactgacgttgaggctcgaaagcgtggggagcaaacaggattagataccctggtagtccacgccgtaaacga<br>tgactgctaggtgtcgggtagcaaagctattcggtgccgcagctaacgcaataagcagtccacctggggagtacgttcgcaag<br>aatgaaactcaaaggaattgacggggacccgcacaagcggtggagcatgtggtttaattcgaagcaacgcgaagaaccttac<br>ctgatcttgacatcccgatgaccgcttcgtaatggaagtttttcttcggaacatcggtgacaggtggtgcatggttgtcgtcagctc<br>gtgtcgtgagatgttgggttaagtcccgcaacgagcgcaacccttatcttcagtagccagcatttaggatgggcactctggaga<br>gactgccagggataacctggaggaaggtggggatgacgtcaaatcatcatgccccttatgaccagggctacacacgtgctac<br>aatggcgtaaacaaagggaggcagagccgcgaggccgagcaaatctcaaaaataacgtctcagttcggattgtagtctgcaa<br>ctcgactacatgaagctggaatcgctagtaatcgcagatcagaatgctgcggtgaatacgttcccgggtcttgtacacaccgcc<br>cgtcacaccatgggagtcagtaacgcccgaagtcagtgacccaaccgaaaggagggagctgccgaaggtgggaccgataa<br>ctggggtgaagtcgtaacaaggtagccgtatcggaaggtgcggctggatcacctccttt |
| *Dorea_formicigenerans* | SEQ ID NO: 119 | acgagagtttgatcctggctcaggatgaacgctggcggcgtgcttaacacatgcaagtcgagcgaagcacataagttcgattct<br>tcggatgaagacttttgtgactgagcggcggacgggtgagtaacgcgtgggtaacctgcctcatacaggggggataacagcta<br>gaaatggctgctaataccgcataagaccacagtactgcatggtacagtggtaaaaactccggtggtatgagatggacccgcgt<br>ctgattaggtagttggtgaggtaacggcccaccaagccgacgatcagtagccgacctgagagggtgaccggccacattggg<br>actgagacacggcccagactcctacgggaggcagcagtggggaatattgcacaatgggcgaaagcctgatgcagcgacgc<br>cgcgtgaaggatgaagtatttcggtatgtaaacttctatcagcagggaagaaaatgacggtacctgactaagaagccccggct<br>aactacgtgccagcagccgcggtaatacgtagggggcaagcgttatccggatttactgggtgtaaagggagcgtagacggct<br>gtgcaagtctgaagtgaaaggcatgggctcaacctgtggactgctttggaaactgtgcagctagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgactgctaggtgtcgggt<br>agcaaagctattcggtgccgcagctaacgcaataagcagtccacctggggagtacgttcgcaagaatgaaactcaaaggaatt<br>gacggggacccgcacaagcggtggagcatgtggtttaattcgaagcaacgcgaagaaccttacctgatcttgacatcccgatg<br>accgcttcgtaatggaagcttttcttcggaacatcggtgacaggtggtgcatggttgtcgtcagctcgtgtcgtgagatgttgggt<br>taagtcccgcaacgagcgcaacccttatcttcagtagccagcatttaggatgggcactctggagagactgccagggataacct<br>ggaggaaggtggggatgacgtcaaatcatcatgccccttatgaccagggctacacacgtgctacaatggcgtaaacaaaggg<br>aagcagagccgcgaggccgagcaaatctcaaaaataacgtctcagttcggattgtagtctgcaactcgactacatgaagctgg |

TABLE 5-continued

Full length 16S rDNA sequences of species (negative correlates)

| Species Name | Sequence Identifier | 16S rDNA sequence |
|---|---|---|
| | | aatcgctagtaatcgcagatcagaatgctgcggtgaatacgttcccgggtcttgtacacaccgcccgtcacaccatgggagtca<br>gtaacgcccgaagtcagtgacccaaccgaaaggagggagctgccgaaggtgggaccgataactggggtgaagtcgtaaca<br>aggtagccgtatcggaaggtgcggctggatcacctccttt |
| *Eubacterium _hallii* | SEQ ID NO: 120 | ctgagtggcggacgggtgagtaacgcgtgggtaacctgccctgtacaggggataacagaggaaacggctgctaataccg<br>cataagcgcacgaggagacatctccttgtgtgaaaaactccggtggtacaggatgggcccgcgtctgattagaggttggcag<br>ggtaacggcctaccaaggcaacgatcagtagccggtctgagaggatgaacggccacattggaactgagacacggtccaaac<br>tcctacgggaggcagcagtggggaatattgcacaatggggaaaccctgatgcagcaacgccgcgtgagtgaagaagtattt<br>cggtatgtaaagctctatcagcagggaagataatgacggtacctgactaagaagaccggctaaatacgtgccagcagccgc<br>ggtaatacgtatggagcaagcgttatccggatttactgggtgtaaagggtgcgtaggtggcagtgcaagtcagatgtgaaagg<br>ccggggctcaaccccggagctgcatttgaaactgctcggctagagtacaggagaggcaggcggaattcctagtgtagcggtg<br>aaatgcgtagatattaggaggaacaccagtggcgaaggcggcctgctggactgttactgacactgaggcacgaaagcgtgg<br>ggagcaaacaggattagataccctggtagtccacgccgtaaacgatgaatactaggtgtcggggccgtataggcttcggtgcc<br>gccgctaacgcagtaagtattccacctggggagtacgttcgcaagaatgaaactcaaaggaattgacggggacccgcacaag<br>cggtggagcatgtggtttaattcgaagcaacgcgaagaaccttaccaggtcttgacatccttctgaccgcaccttaatcggtgctt<br>tccttcgggacagaagagacaggtggtgcatggttgtcgtcagctcgtgtcgtgagatgttgggttaagtcccgcaacgagcg<br>caacccctatcttcagtagccagcaggtaaggctgggcactctggagagactgccagggataacctggaggaaggtgggga<br>cgacgtcaaatcatcatgccccttatgatctgggcgacacacgtgctacaatggcggtcacagagtgaggcgaacccgcgag<br>ggggagcaaaccacaaaaaggecgtcccagttcggactgtagtctgcaacccgactacacgaagctggaatcgctagtaatc<br>gcgaatcagaatgtcgcggtgaatacgttcccgggtcttgtacacaccgcccgtcacaccatgggagtcggaaatgcccgaa<br>gccagtgacccaaccttttggagggagctgtcgaaggtggagccggtaactggggtgaagtcgtaacaaggtagccgtatcg<br>gaaggtgcggctggatcacctccttt |
| *Ruminococc aceae_bacter ium_D16* | SEQ ID NO: 121 | tattgagagtttgatcctggctcaggatgaacgctggcggcgtgcttaacacatgcaagtcgaacggagtgcctttgaaagagg<br>attcgtccaattgataaggttacttagtggcggacgggtgagtaacgcgtgaggaacctgccttggagtggggaataacacagt<br>gaaaattgtgctaataccgcataatgcagttgggccgcatggctctgactgccaaagatttatcgctctgagatggcctcgcgtc<br>tgattagctagttggtggggtaacggcccaccaaggcgacgatcagtagccggactgagaggttggccggccacattggga<br>ctgagacacggcccagactcctacgggaggcagcagtggggaatattgggcaatgggcgcaagcctgacccagcaacgce<br>gcgtgaaggaagaaggctttcgggttgtaaacttcttttcttagggacgaagcaagtgacggtacctaaggaataagccacgg<br>ctaactacgtgccagcagccgcggtaatacgtaggtggcaagcgttatccggatttactgggtgtaaagggcgtgtaggcggg<br>attgcaagtcagatgtgaaaaccacgggctcaacctgtggcctgcatttgaaactgtagttcttgagtactggagaggcagacg<br>gaattcctagtgtagcggtgaaatgcgtagatattaggaggaacaccagtggcgaaggcggtctgctggacagcaactgacg<br>ctgaggcgcgaaagcgtggggagcaaacaggattagataccctggtagtccacgctgtaaacgatggatactaggtgtggg<br>gggtctgaccccttccgtgccgcagttaacacaataagtatcccacctggggagtacgatcgcaaggttgaaactcaaaggaa<br>ttgacgggggcccgcacaagcggtggagtatgtggtttaattcgaagcaacgcgaagaaccttaccagggcttgacatcccg<br>aggcccggtctagagatagacctttctcttcggagacctcggtgacaggtggtgcatggttgtcgtcagctcgtgtcgtgagatg<br>ttgggttaagtcccgcaacgagcgcaacccctattgttagttgctacgcaagagcactctagcgagactgccgttgacaaaacg<br>gaggaaggtggggacgacgtcaaatcatcatgccccttatgtcctgggccacacacgtactacaatggtggttaacagaggg<br>aggcaataccgcgaggtggagcaaacccctaaaagccatcccagttcggattgcaggctgcaacccgcctgcatgaagttgg<br>aatcgctagtaatcgcggatcagcatgccgcggtgaatacgttcccgggccttgtacacaccgcccgtcacaccatgagagtc<br>gggaacacccgaagtccgtagcctaaccgcaagggggcgcggccgaaggtgggttcgataattggggtgaagtcgtaac<br>aaggtagccgtatcggaaggtgcggctggatcacctccttt |
| *Streptococc us_vestibula ris* | SEQ ID NO: 122 | aatgagagtttgatcctggctcaggacgaacgctggcggcgtgcctaatacatgcaagtagaacgctgaagagaggagcttg<br>ctcttcttgaatgagttgcgaacgggtgagtaacgcgtaggtaacctgccttgtagcggggataacattggaaacgatagcta<br>ataccgcataacaatgggtgacacatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtaggaatcttcggcaatgggggcaaccctgaccgagcaacgccgcgtgagtgaa |

TABLE 5-continued

Full length 16S rDNA sequences of species (negative correlates)

| Species Name | Sequence Identifier | 16S rDNA sequence |
| --- | --- | --- |
| | | gaaggttttcggatcgtaaagctctgttgtaagtcaagaacgagtgtgagagtggaaagttcacactgtgacggtagcttaaccg<br>agaaagggacggctaactacgtgccagcagccgcggtaatacgtaggtcccgagcgttgtccggatttattgggcgtaaagc<br>gagcgcaggcggtttgataagtctgaagttaaaggctgtggctcaaccatagttcgctttggaaactgtcaaacttgagtgcaga<br>aggggagagtggaattccatgtgtagcggtgaaatgcgtagatatatggaggaacaccggtggcgaaagcggctctctggtc<br>tgtaactgacgctgaggctcgaaagcgtgggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagaccaatctcagttcggattgtaggctgcaactcgcctacat<br>gaagtcggaatcgctagtaatcgcggatcagcacgccgcggtgaatacgttcccgggccttgtacacaccgcccgtcacacc<br>acgagagtttgtaacacccgaagtcggtgaggtaaccttttggagccagccgcctaaggtgggatagatgattggggtgaagt<br>cgtaacaaggtagccgtatcggaaggtgcggctggatcacctcctt |
| *Streptococcus_vestibularis* | SEQ ID NO: 123 | aatgagagtttgatcctggctcaggacgaacgctggcggcgtgcctaatacatgcaagtagaacgctgaagagaggagcttg<br>ctcttcttgaatgagttgcgaacgggtgagtaacgcgtaggtaacctgccttgtagcgggggataactattggaaacgatagcta<br>ataccgcataacaatgggtgacacatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |
| *Streptococcus_vestibularis* | SEQ ID NO: 124 | aatgagagtttgatcctggctcaggacgaacgctggcggcgtgcctaatacatgcaagtagaacgctgaagagaggagcttg<br>ctcttcttgaatgagttgcgaacgggtgagtaacgcgtaggtaacctgccttgtagcgggggataactattggaaacgatagcta<br>ataccgcataacaatgggtgacacatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgtcgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagtaagttacttcggtacatcggtgacaggtggtgcatggttgtcgtcagctcgtgtcgt |

TABLE 5-continued

| Full length 16S rDNA sequences of species (negative correlates) | | |
|---|---|---|
| Species Name | Sequence Identifier | 16S rDNA sequence |
| | | gagatgttgggttaagtcccgcaacgagcgcaacccctattgttagttgccatcattcagttgggcactctagcgagactgccgt<br>aataaaccggaggaaggtggggatgacgtcaaatcatcatgccccttatgacctgggctacacacgtgctacaatggttggta<br>caacgagttgcgagtcggtgacggcaagctaatctcttaaagccaatctcagttcggattgtaggctgcaactcgcctacatga<br>agtcggaatcgctagtaatcgcggatcagcacgccgcggtgaatacgttcccgggccttgtacacaccgcccgtcacaccac<br>gagagtttgtaacacccgaagtcggtgaggtaaccttttggagccagccgcctaaggtggggtagatgattggggtgaagtcg<br>taacaaggtagccgtatcggaaggtgcggctggatcacctcctt |
| *Streptococcus_vestibularis* | SEQ ID NO: 125 | aatgagagtttgatcctggctcaggacgaacgctggcggcgtgcctaatacatgcaagtagaacgctgaagagaggagcttg<br>ctcttcttgaatgagttgcgaacgggtgagtaacgcgtaggtaacctgccttgtagcgggggataactattggaaacgatagcta<br>ataccgcataacaatggtgacacatgtcattatttgaaaggggcaattgctccactacaagatggacctgcgttgtattagctagt<br>aggtgaggtaacggctcacctaggcgacgatacatagccgacctgagagggtgatcggccacactgggactgagacacgg<br>cccagactcctacgggaggcagcagtagggaatcttcggcaatgggggcaaccctgaccgagcaacgccgcgtgagtgaa<br>gaaggttttcggatcgtaaagctctgttgtaagtcaagaacgagtgtgagagtggaaagttcacactgtgacggtagcttaccag<br>aaagggacggctaactacgtgccagcagccgcggtaatacgtaggtcccgagcgttgtccggatttattgggcgtaaagcga<br>gcgcaggcggtttgataagtctgaagttaaaggctgtggctcaaccatagttcgctttggaaactgtcaaacttgagtgcagaag<br>gggagagtggaattccatgtgtagcggtgaaatgcgtagatatatggaggaacaccggtggcgaaagcggctctctggtctgt<br>aactgacgctgaggctcgaaagcgtggggagcgaacaggattagataccctggtagtccacgccgtaaacgatgagtgcta<br>ggtgttggatcctttccgggattcagtgccgcagctaacgcattaagcactccgcctggggagtacgaccgcaaggttgaaact<br>caaaggaattgacgggggcccgcacaagcggtggagcatgtggtttaattcgaagcaacgcgaagaaccttaccaggtcttg<br>acatcccgatgctatttctagagatagaaagttacttcggtacatcggtgacaggtggtgcatggagtcgtcagctcgtgtcgtg<br>agatgttgggttaagtcccgcaacgagcgcaacccctattgttagttgccatcattcagttgggcactctagcgagactgccggt<br>aataaaccggaggaaggtggggatgacgtcaaatcatcatgccccttatgacctgggctacacacgtgctacaatggttggta<br>caacgagttgcgagtcggtgacggcaagctaatctcttaaagccaatctcagttcggattgtaggctgcaactcgcctacatga<br>agtcggaatcgctagtaatcgcggatcagcacgccgcggtgaatacgttcccgggccttgtacacaccgcccgtcacaccac<br>gagagtttgtaacacccgaagtcggtgaggtaaccttttggagccagccgcctaaggtgggatagatgattggggtgaagtcg<br>taacaaggtagccgtatcggaaggtgcggctggatcacctcctt |
| *Streptococcus_vestibularis* | SEQ ID NO: 126 | aatgagagtttgatcctggctcaggacgaacgctggcggcgtgcctaatacatgcaagtagaacgctgaagagaggagcttg<br>ctcttcttgaatgagttgcgaacgggtgagtaacgcgtaggtaacctgccttgtagcgggggataactattggaaacgatagcta<br>ataccgcataacaatgggtgacacatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |

TABLE 5-continued

Full length 16S rDNA sequences of species (negative correlates)

| Species Name | Sequence Identifier | 16S rDNA sequence |
|---|---|---|
| *Streptococcus_vestibularis* | SEQ ID NO: 127 | aatgagagtttgatcctggctcaggacgaacgctggcggcgtgcctaatacatgcaagtagaacgctgaagagaggagcttg ctcttcttgaatgagttgcgaacgggtgagtaacgcgtaggtaacctgccttgtagcgggggataactattggaaacgatagcta ataccgcataacaatgggtgacacatgtcatttatttgaaaggggcaattgctccactacaagatggacctgcgttgtattagcta gtaggtgaggtaacggctcacctaggcgacgatacatagccgacctgagagggtgatcggccacactgggactgagacacg gcccagactcctacgggaggcagcagtagggaatcttcggcaatgggggcaaccctgaccgagcaacgccgcgtgagtga agaaggttttcggatcgtaaagctctgttgtaagtcaagaacgagtgtgagagtggaaagttcacactgtgacggtagcttacca gaaagggacggctaactacgtgccagcagccgcggtaatacgtaggtcccgagcgttgtccggatttattgggcgtaaagcg agcgcaggcggtttgataagtctgaagttaaaggctgtggctcaaccatagttcgctttggaaactgtcaaacttgagtgcagaa ggggagagtggaattccatgtgtagcggtgaaatgcgtagatatatggaggaacaccggtggcgaaagcggctctctggtct gtaactgacgctgaggctcgaaagcgtggggagcgaacaggattagataccctggtagtccacgccgtaaacgatgagtgct aggtgttggatcctttccgggattcagtgccgcagctaacgcattaagcactccgcctggggagtacgaccgcaaggttgaaa ctcaaaggaattgacgggggcccgcacaagcggtggagcatgtggtttaattcgaagcaacgcgaagaaccttaccaggtct tgacatcccgatgctatttctagagatagaaagttacttcggtacatcggtgacaggtggtgcatggttgtcgtcagctcgtgtcgt gagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggttggt acaacgagttgcgagtcggtgacggcaagctaatctcttaaagccaatctcagttcggattgtaggctgcaactcgcctacatg aagtcggaatcgctagtaatcgcggatcagcacgccgcggtgaatacgttcccgggccttgtacacaccgcccgtcacacca cgagagtttgtaacacccgaagtcggtgaggtaaccttttggagccagccgcctaaggtgggatagatgattggggtgaagtc gtaacaaggtagccgtatcggaaggtgcggctggatcacctcctt |
| *Streptococcus_thermophilus* | SEQ ID NO: 128 | aatgagagtttgatcctggctcaggacgaacgctggcggcgtgcctaatacatgcaagtagaacgctgaagagaggagcttg ctcttcttggatgagttgcgaacgggtgagtaacgcgtaggtaacctgccttgtagcgggggataactattggaaacgatagct aataccgcataacaatggatgacacatgtcatttatttgaaaggggcaattgctccactacaagatggacctgcgttgtattagct agtaggtgaggtaatggctcacctaggcgacgatacatagccgacctgagagggtgatcggccacactgggactgagacac ggcccagactcctacgggaggcagcagtagggaatcttcggcaatgggggcaaccctgaccgagcaacgccgcgtgagtg aagaaggttttcggatcgtaaagctctgttgtaagtcaagaacgggtgtgagagtggaaagttcacactgtgacggtagcttacc agaaagggacggctaactacgtgccagcagccgcggtaatacgtaggtcccgagcgttgtccggatttattgggcgtaaagc gagcgcaggcgggttgataagtctgaagttaaaggctggggctcaaccatagttcgctttggaaactgtcaaacttgagtgcag aaggggagagtggaattccatgtgtagcggtgaaatgcgtagatatatggaggaacaccggtggcgaaagcggctctctggt ctgtaactgacgctgaggctcgaaagcgtggggagcgaacaggattagataccctggtagtccacgccgtaaacgatgagtg ctaggtgaggatcctttccgggattcagtgccgaagctaacgcattaagcactccgcctggggagtacgaccgcaaggttgaa actcaaaggaattgacgggggcccgcacaagcggtggagcatgtggtttaattcgaagcaacgcgaagaaccttaccaggtc ttgacatcccgatgctatttctagagatagaaagttacttcggtacatcggtgacaggtggtgcatggttgtcgtcagctcgtgtcg tgagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggttggt acaacgagttgcgagtcggtgacggcgagctaatctcttaaagccaatctcagttcggattgtaggctgcaactcgcctacatg aagtcggaatcgctagtaatcgcggatcagcacgccgcggtgaatacgttcccgggccttgtacacaccgcccgtcacacca cgagagtttgtaacacccgaagtcggtgaggtaaccttttggagccagccgcctaaggtgggacagatgattggggtgaagtc gtaacaaggtagccgtatcggaaggtgcggctgggtcacctcctt |
| *Streptococcus_thermophilus* | SEQ ID NO: 129 | atgaaagtttgatcctggctcaggacgaacgctggcggcgtgcctaatacatgcaagtagaacgctgaagagaggagcttgct cttcttggatgagttgcgaacgggtgagtaacgcgtaggtaacctgccttgtagcgggggataactattggaaacgatagctaa taccgcataacaatggatgacacatgtcatttatttgaaaggggcaattgctccactacaagatggacctgcgttgtattagctagt aggtgaggtaatggctcacctaggcgacgatacatagccgacctgagagggtgatcggccacactgggactgagacacggc ccagactcctacgggaggcagcagtagggaatcttcggcaatgggggcaaccctgaccgagcaacgccgcgtgagtgaag aaggttttcggatcgtaaagctctgttgtaagtcaagaacgggtgtgagagtggaaagttcacactgtgacggtagcttaccaga aagggacggctaactacgtgccagcagccgcggtaatacgtaggtcccgagcgttgtccggatttattgggcgtaaagcgag |

TABLE 5-continued

Full length 16S rDNA sequences of species (negative correlates)

| Species Name | Sequence Identifier | 16S rDNA sequence |
|---|---|---|
| | | cgcaggcggtttgataagtctgaagttaaaggctgtggctcaaccatagttcgctttggaaactgtcaaacttgagtgcagaagg<br>ggagagtggaattccatgtgtagcggtgaaatgcgtagatatatggaggaacaccggtggcgaaagcggctcactggtctgta<br>actgacgctgaggctcgaaagcgtggggagcgaacaggattagataccctggtagtccacgccgtaaacgatgagtgctag<br>gtgttggatcctttccgggattcagtgccgcagctaacgcattaagcactccgcctggggagtacgaccgcaaggttgaaactc<br>aaaggaattgacgggggcccgcacaagcggtggagcatgtggtttaattcgaagcaacgcgaagaaccttaccaggtcttga<br>catcccgatgctatttctagagatagaaagttacttcggtacatcggtgacaggtggtgcatggttgtcgtcagctcgtgtcgtga<br>gatgttgggttaagtcccgcaacgagcgcaacccctattgttagttgccatcattcagttgggcactctagcgagactgccggta<br>ataaaccggaggaaggtggggatgacgtcaaatcatcatgccccttatgacctgggctacacacgtgctacaatggttggtac<br>aacgagttgcgagtcggtgacggcgagctaatctcttaaagccaatctcagttcggattgtaggctgcaactcgcctacatgaa<br>gtcggaatcgctagtaatcgcggatcagcacgccgcggtgaatacgttcccgggccttgtacacaccgcccgtcacaccacg<br>agagtttgtaacacccgaagtcggtgaggtaacctttggagccagccgcctaaggtgggacagatgattggggtgaagtcgt<br>aacaaggtagccgtatcggaaggtgcggctggatcacctcctt |
| *Streptococc us_thermop* hilus | SEQ ID NO: 130 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatggatgacacatgtcatttatttgaaaggggcaattgctccactacaagatggacctgcgttgtattagct<br>agtaggtgaggtaatggctcacctaggcgacgatacatagccgacctgagagggtgatcggccacactgggactgagacac<br>ggcccagactcctacgggaggcagcagtagggaatcttcggcaatgggggcaaccctgaccgagcaacgccgcgtgagtg<br>aagaaggttttcggatcgtaaagctctgttgtaagtcaagaacgggtgtgagagtggaaagttcacactgtgacggtagcttacc<br>agaaagggacggctaactacgtgccagcagccgcggtaatacgtaggtcccgagcgttgtccggatttattgggcgtaaagc<br>gagcgcaggcggtttgataagtctgaagttaaaggctgtggctcaaccatagttcgctttggaaactgtcaaacttgagtgcaga<br>aggggagagtggaattccatgtgtagcggtgaaatgcgtagatatatggaggaacaccggtggcgaaagcggctctctggtc<br>tgtaactgacgctgaggctcgaaagcgtggggagcgaacaggattagataccctggtagtccacgccgtaaacgatgagtgc<br>taggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcgagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaacctttggagccagccgcctaaggtgggacagatgattggggtgaagtc<br>gtaacaaggtagccgtatcggaaggtgcggctggatcacctcctt |
| *Streptococc us_thermop* hilus | SEQ ID NO: 131 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatggatgacacatgtcatttatttgaaaggggcaattgctccactacaagatggacctgcgttgtattagct<br>agtaggtgaggtaatggctcacctaggcgacgatacatagccgacctgagagggtgatcggccacactgggactgagacac<br>ggcccagactcctacgggaggcagcagtagggaatcttcggcaatgggggcaaccctgaccgagcaacgccgcgtgagtg<br>aagaaggttttcggatcgtaaagctctgttgtaagtcaagaacgggtgtgagagtggaaagttcacactgtgacggtagcttacc<br>agaaagggacggctaactacgtgccagcagccgcggtaatacgtaggtcccgagcgttgtccggatttattgggcgtaaagc<br>gagcgcaggcgggttgataagtctgaagttaaaggctggggctcaaccatagttcgctttggaaactgtcaaacttgagtgcag<br>aaggggagagtggaattccatgtgtagcggtgaaatgcgtagatatatggaggaacaccggtggcgaaagcggctctctggt<br>ctgtaactgacgctgaggctcgaaagcgtggggagcgaacaggattagataccctggtagtccacgccgtaaacgatgagtg<br>ctaggtgaggatcctttccgggattcagtgccgcagctaacgcattaagcactccgcctggggagtacgaccgcaaggttgaa<br>actcaaaggaattgacgggggcccgcacaagcggtggagcatgtggtttaattcgaagcaacgcgaagaaccttaccaggtc<br>ttgacatcccgatgctatttctagagatagaaagttacttcggtacatcggtgacaggtggtgcatggttgtcgtcagctcgtgtcg<br>tgagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt |

TABLE 5-continued

Full length 16S rDNA sequences of species (negative correlates)

| Species Name | Sequence Identifier | 16S rDNA sequence |
|---|---|---|
| | | acaacgagttgcgagtcggtgacggcgagctaatctcttaaagccaatctcagttcggattgtaggctgcaactcgcctacatg aagtcggaatcgctagtaatcgcggatcagcacgccgcggtgaatacgttcccgggccttgtacacaccgcccgtcacacca cgagagtttgtaacacccgaagtcggtgaggtaacctttggagccagccgcctaaggtgggacagatgattggggtgaagtc gtaacaaggtagccgtatcggaaggtgcggctggtcacctcctt |
| *Streptococcus_thermophilus* | SEQ ID NO: 132 | aatgagagtttgatcctggctcaggacgaacgctggcggcgtgcctaatacatgcaagtagaacgctgaagagaggagcttg ctcttcttggatgagttgcgaacgggtgagtaacgcgtaggtaacctgccttgtagcgggggataactattggaaacgatagct aataccgcataacaatggatgacacatgtcatttatttgaaaggggcaattgctccactacaagatggacctgcgttgtattagct agtaggtgaggtaatggctcacctaggcgacgatacatagccgacctgagagggtgatcggccacactgggactgagacac ggcccagactcctacgggaggcagcagtagggaatcttcggcaatgggggcaaccctgaccgagcaacgccgcgtgagtg aagaaggttttcggatcgtaaagctctgttgtaagtcaagaacgggtgtgagagtggaaagttcacactgtgacggtagcttacc agaaagggacggctaactacgtgccagcagccgcggtaatacgtaggtcccgagcgttgtccggatttattgggcgtaaagc gagcgcaggcgggttgataagtctgaagttaaaggctgtggctcaaccatagttcgctttggaaactgtcaaacttgagtgcag aaggggagagtggaattccatgtgtagcggtgaaatgcgtagatatatggaggaacaccggtggcgaaagcggctctctggt ctgtaactgacgctgaggctcgaaagcgtggggagcgaacaggattagataccctggtagtccacgccgtaaacgatgagtg ctaggtgttggatcctttccgggattcagtgccgcagctaacgcattaagcactccgcctggggagtacgaccgcaaggttgaa actcaaaggaattgacgggggcccgcacaagcggtggagcatgtggtttaattcgaagcaacgcgaagaaccttaccaggtc ttgacatcccgatgctatttctagagatagaaagttacttcggtacatcggtgacaggtgggcatggttgtcgtcagctcgtgtcgt gagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggttggt acaacgagttgcgagtcggtgacggcgagctaatctcttaaagccaatctcagttcggattgtaggctgcaactcgcctacatg aagtcggaatcgctagtaatcgcggatcagcacgccgcggtgaatacgttcccgggccttgtacacaccgcccgtcacacca cgagagtttgtaacacccgaagtcggtgaggtaacctttggagccagccgcctaaggtgggacagatgattggggtgaagtc gtaacaaggtagccgtatcggaaggtgcggctgggtcacctcctt |
| *Prevotella_buccae* | SEQ ID NO: 133 | cgtatccaaccttcccgcgaccaagggataacctgccgaaaggcagactaataccttatgtcctcctttgaaggcatctgacga ggagcaaagatccgtcggtcacggatggggatgcgtccgattagcttgaggcggggcaacggcccaccaaggcttcgatc ggtaggggttctgagaggaaggcccccacactggaactgagacacggtccagactcctacgggaggcagcagtgaggaa tattggtcaatgggcggaagcctgaaccagccaagtagcgtgcaggatgacggccctacgggttgtaaactgcttttatgcgg ggataaagttgcccacgcgtgggtttttgcaggtaccgcatgaataaggaccggctaattccgtgccagcagccgcggtaata cggaaggtccgggcgttatccggatttattgggtttaaagggagcgcaggccgccgtgcaagcgtgccgtgaaaagcagcg gcccaaccgctgccctgcggcgcgaactgcttggcttgagtgcgccggaagcgggcggaattcgtggtgtagcggtgaaat gcttagatatcacgaagaaccccgattgcgaaggcagcccgctgtggcgccactgacgctgaggctcgaaggtgcgggtat cgaacaggattagataccctggtagtccgcacggtaaacgatggatacccgctgtccggcccgtacggtctgggcggccaag cgaaagcgttaagtatcccacctggggagtacgccggcaacggtgaaactcaaaggaattgacgggggcccgcacaagcg gaggaacatgtggtttaattcgatgatacgcgaggaaccttacccgggcttgaattgcaggagaatgattcagagatgatgaag tccctcgggactcctgtgaaggtgctgcatggagtcgtcagctcgtgccgtgaggtgtcggctcaagtgccataacgagcgca acccctctccgcagttgccatcgggtcatgccgggcactctgcggacactgccgccgcaaggtgcgaggaaggtggggatg acgtcaaatcagcacggcccttacgtccggggccacacacgtgttacaatggccggcacagagggctgtccgcatgcaagtg cgggcgaatccccaaatccggtcccagttcggactggggtctgcaacccgaccccacgaagctggattcgctagtaatcgcg catcagccatggcgcggtgaatacgttcccgggccttgtacacaccgcccgtcaagccatgaaagccgggggtgcctgaagt ccgtgaccgcgagggtcggcctagggcaaaaccggtgattggggctaagtcgtaacaaggtagccgtaccggaaggtgcg gctggaacacctccttt |
| *Lachnospiraceae_bacterium_5_1_63* FAA | SEQ ID NO: 134 | atgagagtttgatcctggctcaggatgaacgctggcggcgtgcttaacacatgcaagtcgaacgaaacaccttatttgattttctt cggaactgaagatttggtgattgagtggcggacgggtgagtaacgcgtgggtaacctgccctgtacaggggggataacagtca gaaatgactgctaataccgcataagaccacagcaccgcatggtgcaggggtaaaaactccggtggtacaggatggacccgc gtctgattagctggttggtgaggtaacggctcaccaaggcgacgatcagtagccggcttgagagagtgaacggccacattgg |

TABLE 5-continued

Full length 16S rDNA sequences of species (negative correlates)

| Species Name | Sequence Identifier | 16S rDNA sequence |
| --- | --- | --- |
| | | gactgagacacggcccaaactcctacgggaggcagcagtggggaatattgcacaatgggggaaaccctgatgcagcgacg<br>ccgcgtgagtgaagaagtatctcggtatgtaaagctctatcagcagggaagaaaatgacggtacctgactaagaagccccgg<br>ctaactacgtgccagcagccgcggtaatacgtagggggcaagcgttatccggaattactgggtgtaaagggtgcgtaggtggt<br>atggcaagtcagaagtgaaaacccagggcttaactctgggactgcttttgaaactgtcagactggagtgcaggagaggtaagc<br>ggaattcctagtgtagcggtgaaatgcgtagatattaggaggaacatcagtggcgaaggcggcttactggactgaaactgaca<br>ctgaggcacgaaagcgtggggagcaaacaggattagataccctggtagtccacgccgtaaacgatgaatactaggtgtcgg<br>ggccgtagaggcttcggtgccgcagccaacgcagtaagtattccacctggggagtacgttcgcaagaatgaaactcaaagga<br>attgacggggacccgcacaagcggtggagcatgtggtttaattcgaagcaacgcgaagaaccttacctggtcttgacatccttc<br>tgaccggtccttaaccggacctttccttcgggacaggagagacaggtggtgcatggttgtcgtcagctcgtgtcgtgagatgttg<br>ggttaagtcccgcaacgagcgcaacccctatctttagtagccagcatataaggtgggcactctagagagactgccagggataa<br>cctggaggaaggtggggacgacgtcaaatcatcatgccccttatgaccagggctacacacgtgctacaatggcgtaaacaga<br>gggaagcagcctcgtgagagtgagcaaatcccaaaaataacgtctcagttcggattgtagtctgcaactcgactacatgaagct<br>ggaatcgctagtaatcgcgaatcagaatgtcgcggtgaatacgttcccgggtcttgtacacaccgcccgtcacaccatgggag<br>tcagtaacgcccgaagtcagtgacccaaccgtaaggagggagctgccgaaggcgggaccgataactggggtgaagtcgta<br>acaaggtagccgtatcggaaggtgcggctggatcacctccttt |
| *Lachnospiraceae_bacterium_8_1_57FAA* | SEQ ID NO: 135 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacaggggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcctttcggggcagcggagacaggtggtgcatggttgtcgtcagctcgtgtcgtgagatgt<br>tgggttaagtcccgcaacgagcgcaacccctatctttagtagccagcggccaggccgggcactctagagagactgccgggg<br>ataacccggaggaaggtggggatgacgtcaaatcatcatgccccttatgagcagggctacacacgtgctacaatggcgtaaa<br>caaagggaagcgagaccgcgaggtggagcaaatcccaaaaataacgtctcagttcggattgtagtctgcaactcgactacatg<br>aagctggaatcgctagtaatcgcgaatcagaatgtcgcggtgaatacgttcccgggtcttgtacacaccgcccgtcacaccatg<br>ggagtcagtaacgcccgaagtcagtgacccaaccgtaaggagggagctgccgaaggcgggaccgataactggggtgaagt<br>cgtaacaaggtagccgtatcggaaggtgcggctggatcacctccttt |
| *Streptococcus_australis* | SEQ ID NO: 136 | aatgagagtttgatcctggctcaggatgaacgctggcggcgtgcctaatacatgcaagtagaacgctgaaggaaggagcttgc<br>tctttctggatgagttgcgaacgggtgagtaacgcgtaggtaacctgcctggtagcgggggataactattggaaacgatagcta<br>ataccgcataacagtagatgttgcatgatatctgcttgaaaggggcaattgctccactaccagatggacctgcgttgtattagcta<br>gttggtgaggtaacggctcaccaaggcgacgatacatagccgacctgagagggtgatcggccacactgggactgagacacg<br>gcccagactcctacgggaggcagcagtagggaatcttcggcaatggacggaagtctgaccgagcaacgccgcgtgagtga<br>agaaggttttcggatcgtaaagctctgttgtaagagaagaacgagtgtgagagtggaaagttcacactgtgacggtatcttacca<br>gaaagggacggctaactacgtgccagcagccgcggtaatacgtaggtcccgagcgttatccggatttattgggcgtaaagcg<br>agcgcaggcggttagataagtctgaagttaaaggctgtggcttaaccatagtacgctttggaaactgtttaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcaaacaggattagataccctggtagtccacgccgtaaacgatgagtgct<br>aggtgttgggtcctttccgggactcagtgccgtagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct |

TABLE 5-continued

Full length 16S rDNA sequences of species (negative correlates)

| Species Name | Sequence Identifier | 16S rDNA sequence |
|---|---|---|
| | | tgacatccctctgatcgctctagagatagagttttccttcgggacagaggtgacaggtggtgcatggttgtcgtcagctcgtgtcg tgagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggctgg tacaacgagtcgcaagtcggtgacggcaagctaatctcttaaagccagtctcagttcggattgtaggctgcaactcgcctacat gaagtcggaatcgctagtaatcgcggatcagcacgccgcggtgaatacgttcccgggccttgtacacaccgcccgtcacacc acgagagtttgtaacacccgaagtcggtgaggtaacctttttaggagccagccgcctaaggtgggatagatgattggggtgaag tcgtaacaaggtagccgtatcggaaggtgcggctggatcacctcctt |
| *Lachnospira ceae_bacteri um_4_1_37* FAA | SEQ ID NO: 137 | aacgagagtttgatcctggctcaggatgaacgctggcggcgtgcttaacacatgcaagtcgaacgaagcacttgaatggaatt cttcggaaggaagctcaagtgactgagtggcggacgggtgagtaacgcgtgggtaacctgcctcatacaggggggataacag ttagaaatgactgctaataccgcataagcacacgtgatcgcatgatcgagtgtgaaaaactccggtggtatgagatggacccgc gtctgattagctagttggtggggtaacggcccaccaaggcgacgatcagtagccggcctgagagggtgaacggccacattg ggactgagacacggcccaaactcctacgggaggcagcagtggggaatattgcacaatggggggaaaccctgatgcagcgac gccgcgtgaaggatgaagtatttcggtatgtaaacttctatcagcagggaagaaaatgacggtacctgactaagaagccccgg ctaactacgtgccagcagccgcggtaatacgtagggggcaagcgttatccggatttactgggtgtaaagggagcgtagacgg cagtgcaagtctgaagtgaaagcccggggctcaaccccgggactgctttggaaactgtgcagctagagtgtcggagaggca agcggaattcctagtgtagcggtgaaatgcgtagatattaggaggaacaccagtggcgaaggcggcttgctggacgatgact gacgttgaggctcgaaagcgtggggagcaaacaggattagataccctggtagtccacgccgtaaacgatgactactaggtgt cggggagcaaagctcttcggtgccgcagccaacgcaataagtagtccacctggggagtacgttcgcaagaatgaaactcaaa ggaattgacggggacccgcacaagcggtggagcatgtggtttaattcgaagcaacgcgaagaaccttacctgctcttgacatc cctctgaccggcaagtaatgttgcctttccttcgggacagaggagacaggtggtgcatggttgtcgtcagacgtgtcgtgagat gttgggttaagtcccgcaacgagcgcaacccctatcttcagtagccagcggtaaggccgggcactctggagagactgccagg gataacctggaggaaggtggggatgacgtcaaatcatcatgccccttatgagcagggctacacacgtgctacaatggcgtaaa caaagggaagcagagtcgtgaggccgagcaaatcccaaaaataacgtctcagttcggattgtagtctgcaactcgactacatg aagctggaatcgctagtaatcgcgaatcagaatgtcgcggtgaatacgttcccgggtcttgtacacaccgcccgtcacaccatg ggagtcagtaacgcccgaagtcagtgacccaaccgcaaggagggagctgccgaaggtgggaccgataactggggtgaagt cgtaacaaggtagccgtatcggaaggtgcggctggatcacctccttt |
| *Streptococc us_sanguinis* | SEQ ID NO: 138 | aatgagagtttgatcctggctcaggacgaacgctggcggcgtgcctaatacatgcaagtagaacgctgaagagaggagcttg ctcttcttggatgagttgcgaacgggtgagtaacgcgtaggtaacctgcctggtagcgggggataactattggaaacgatagct aataccgcatgatattaattatcgcatgataattaattgaaagatgcaattgcatcactaccagatggacctgcgttgtattagctag ttggtgaggtaacggctcaccaaggcgacgatacatagccgacctgagagggtgatcggccacactgggactgagacacgg cccagactcctacgggaggcagcagtagggaatcttcggcaatgggggggaaccctgaccgagcaacgccgcgtgagtgaa gaaggttttcggatcgtaaagctctgttgtaagagaagaacgggtgtgagagtggaaagttcacactgtgacggtatcttacca gaaagggacggctaactacgtgccagcagccgcggtaatacgtaggtcccgagcgttgtccggatttattgggcgtaaagcg agcgcaggcggttagataagtctgaagttaaaggctgtggcttaaccatagtatgctttggaaactgtttaacttgagtgcagaa ggggagagtggaattccatgtgtagcggtgaaatgcgtagatatatggaggaacaccggtggcgaaagcggctctctggtct gtaactgacgctgaggctcgaaagcgtggggagcaaacaggattagataccctggtagtccacgccgtaaacgatgagtgct aggtgttaggccctttccggggcttagtgccgcagctaacgcattaagcactccgcctggggagtacgaccgcaaggttgaaa ctcaaaggaattgacgggggcccgcacaagcggtggagcatgtggtttaattcgaagcaacgcgaagaaccttaccaggtct tgacatccctctgaccgctctagagatagagttttccttcgggacagaggtgacaggtggtgcatggttgtcgtcagctcgtgtc gtgagatgttgggttaagtcccgcaacgagcgcaacccctattgttagttgccatcattgagttgggcactctagcgagactgcc ggtaataaaccggaggaaggtggggatgacgtcaaatcatcatgccccttatgacctgggctacacacgtgctacaatggctg gtacaacgagtcgcaagccggtgacggcaagctaatctctgaaagccagtctcagttcggattgtaggctgcaactcgcctac atgaagtcggaatcgctagtaatcgcggatcagcacgccgcggtgaatacgttcccgggccttgtacacaccgcccgtcacac cacgagagtttgtaacacccgaagtcggtgaggtaaccgtaaggagccagccgcctaaggtgggatagatgattggggtgaa gtcgtaacaaggtagccgtatcggaaggtgcggctggatcacctcctt |

TABLE 5-continued

Full length 16S rDNA sequences of species (negative correlates)

| Species Name | Sequence Identifier | 16S rDNA sequence |
| --- | --- | --- |
| *Lachnospira ceae_bacteri um_3_1_46* FAA | SEQ ID NO: 139 | aacgagagtttgatcctggctcaggatgaacgctggcggcgtgcctaacacatgcaagtcgagcgaagcactttgcttagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcggggtaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcccttcggggcagcggagacaggtggtgcatggttgtcgtcagctcgtgtcgtgagatgt<br>tgggttaagtcccgcaacgagcgcaacccctatctttagtagccagcggccaggccgggcactctagagagactgccgggg<br>ataacccggaggaaggtggggatgacgtcaaatcatcatgccccttatgagcagggctacacacgtgctacaatggcgtaaa<br>caaagggaagcgagaccgcgaggtggagcaaatcccaaaaataacgtctcagttcggattgtagtctgcaactcgactacatg<br>aagctggaatcgctagtaatcgcgaatcagaatgtcgcggtgaatacgttcccgggtcttgtacacaccgcccgtcacaccatg<br>ggagtcagtaacgcccgaagtcagtgacccaaccgtaaggagggagctgccgaaggcgggaccgataactggggtgaagt<br>cgtaacaaggtagccgtatcggaaggtgcggctggatcacctccttt |
| *Lachnospira ceae_bacteri um_6_1_63* FAA | SEQ ID NO: 140 | tcagagagtttgatcctggctcaggatgaacgctggcggcgtgcttaacacatgcaagtcgagcgaagcacttatcattgactct<br>tcggaagatttgatatttgactgagcggcggacgggtgagtaacgcgtgggtaacctgcctcatacaggggaataacagttag<br>aaatggctgctaatgccgcataagcgcacaggaccgcatggtctggtgtgaaaaactgaggtggtatgagatggacccgcgt<br>ctgattaggtagttggtggggtaacggcctaccaagccgacgatcagtagccggcctgagagggtgaacggccacattggg<br>actgagacacggcccagactcctacgggaggcagcagtggggaatattgcacaatgggggaaaccctgatgcagcgacgc<br>cgcgtgaaggaagaagtatctcggtatgtaaacttctatcagcagggaagaaaatgacggtacctgactaagaagccccggct<br>aactacgtgccagcagccgcggtaatacgtagggggcaagcgttatccggatttactgggtgtaaagggagcgtagacggaa<br>gagcaagtctgatgtgaaaggctggggcttaaccccaggactgcattggaaactgtttttctagagtgccggagaggtaagcg<br>gaattcctagtgtagcggtgaaatgcgtagatattaggaggaacaccagtggcgaaggcggcttactggacggtaactgacgt<br>tgaggctcgaaagcgtggggagcaaacaggattagataccctggtagtccacgccgtaaacgatgaatactaggtgtcgggg<br>tgcaaagcagttcggtgccgcagcaaacgcaataagtattccacctggggagtacgttcgcaagaatgaaactcaaaggaatt<br>gacggggacccgcacaagcggtggagcatgtggtttaattcgaagcaacgcgaagaaccttaccaagtcttgacatctgcctg<br>accgttccttaaccggagctttccttcgggacaggcaagacaggtggtgcatggttgtcgtcagctcgtgtcgtgagatgttggg<br>ttaagtcccgcaacgagcgcaacccctatccttagtagccagcagtccggctgggcactctagggagactgccggggataac<br>ccggaggaaggcggggacgacgtcaaatcatcatgccccttatgatttgggctacacacgtgctacaatggcgtaaacaaag<br>ggaagcgaagcggtgacgcttagcaaatctcaaaaataacgtcccagttcggactgcagtctgcaactcgactgcacgaagct<br>ggaatcgctagtaatcgcgaatcagaatgtcgcggtgaatacgttcccgggtcttgtacacaccgcccgtcacaccatgggag<br>tcagtaacgcccgaagtcagtgacccaaccttatggagggagctgccgaaggcgggaccgataactggggtgaagtcgtaa<br>caaggtagccgtatcggaaggtgcggctggatcacctccttt |
| *Lachnospira ccae bacteri um_9_1_43* BFAA | SEQ ID NO: 141 | aacgagagtttgatcctggctcaggatgaacgctggcggcgtgcttaacacatgcaagtcgaacgaagcacttgaatggaatt<br>cttcggaaggaagctcaagtgactgagtggcggacgggtgagtaacgcgtgggtaacctgcctcatacagggggataacag<br>ttagaaatgactgctaataccgcataagcacacgtgatcgcatgatcgagtgtgaaaaactccggtggtatgagatggacccgc<br>gtctgattagctagttggtggggtaatggcccaccaaggcgacgatcagtagccggcctgagagggtgaacggccacattgg<br>gactgagacacggcccaaactcctacgggaggcagcagtggggaatattgcacaatgggggaaaccctgatgcagcgacg<br>ccgcgtgaaggatgaagtatttcggtatgtaaacttctatcagcagggaagaaaatgacggtacctgactaagaagccccggc<br>taactacgtgccagcagccgcggtaatacgtagggggcaagcgttatccggatttactgggtgtaaagggagcgtagacggc<br>agtgcaagtctgaagtgaaagcccggggctcaaccccgggactgctttggaaactgtgcagctagagtgtcggagaggcaa |

TABLE 5-continued

Full length 16S rDNA sequences of species (negative correlates)

| Species Name | Sequence Identifier | 16S rDNA sequence |
|---|---|---|
| | | gcggaattcctagtgtagcggtgaaatgcgtagatattaggaggaacaccagtggcgaaggcggcttgctggacgatgactg acgttgaggctcgaaagcgtggggagcaaacaggattagataccctggtagtccacgccgtaaacgatgactactaggtgtc ggggagcaaagctcttcggtgccgcagccaacgcaataagtagtccacctggggagtacgttcgcaagaatgaaactcaaag gaattgacggggacccgcacaagcggtggagcatgtggtttaattcgaagcaacgcgaagaaccttacctgctcttgacatcc ctctgaccgctctttaatcggagctttccttcgggacagaggagacaggtggtgcatggttgtcgtcagctcgtgtcgtgagatg ttgggttaagtcccgcaacgagcgcaacccctatcttcagtagccagcggtaaggccgggcactctggagagactgccaggg ataacctggaggaaggtggggatgacgtcaaatcatcatgccccttatgagcagggctacacacgtgctacaatggcgtaaac aaagggaagcagagtcgtgaggccgagcaaatcccaaaaataacgtctcagttcggattgtagtctgcaactcgactacatga agctggaatcgctagtaatcgcgaatcagaatgtcgcggtgaatacgttcccgggtcttgtacacaccgcccgtcacaccatgg gagtcagtaacgcccgaagtcagtgacccaaccgcaaggagggagctgccgaaggtgggaccgataactggggtgaagtc gtaacaaggtagccgtatcggaaggtgcggctggatcacctccttt |
| *Ruminococc us_bromii* | SEQ ID NO: 142 | atatcaaagattttatcgcttgaagatggactcgcgtccgattagttagttggtgaggtaacggctcaccaagaccgcgatcggt agccggactgagaggttgaacggccacattgggactgagacacggcccagactcctacgggaggcagcagtgggggatat tgcgcaatgggggcaaccctgacgcagcaacgccgcgtgaaggatgaaggttttcggattgtaaacttcttttattaaggacga aacttgacggtacttaatgaataagctccggctaactacgtgccagcagccgcggtaatacgtagggagcaagcgttgtccgg atttactgggtgtaaagggtgcgtaggcggctttgcaagtcagatgtgaaatctatgggctcaacccataaactgcatttgaaact gtagagcttgagtgaagtagaggcaggcggaattccccgtgtagcggtgaaatgcgtagagatggggaggaacaccagtgg cgaaggcggcctgctgggctttaactgacgctgaggcacgaaagcgtgggtagcaaacaggattagataccctggtagtcca cgctgtaaacgatgattactaggtgtgggggtctgaccccttccgtgccggagttaacacaataagtaatccacctggggagt acggccgcaaggttgaaactcaaaggaattgacgggggcccgcacaagcagtggagtatgtggtttaattcgaagcaacgc gaagaaccttaccaggtcttgacatccaactaacgaagtagagatacattaggtgcccttcggggaaagttgagacaggtggt gcatggttgtcgtcagctcgtgtcgtgagatgttgggttaagtcccgcaacgagcgcaacccttgctattagttgctacgcaaga gcactctaataggactgccgttgacaaaacggaggaaggtggggacgacgtcaaatcatcatgccccttatgacctgggctac acacgtactacaatggatgttaacagagggaagcaagacagcgatgtggagcaaacccctaaaaacattctcagttcagattg caggctgcaacccgcctgcatgaagatggaattgctagtaatcgcggatcagcatgccgcggtgaatacgttcccgggccttg tacacaccgcccgtcacaccatgggagccggtaatacccgaagtcagtagtccaacctcgtgaggacgctgccgaaggtag gattggcgactggggtgaagtcgtaacaaggtagccgtatcggaaggtgcggctggatcacctccttt |
| *Coprococcu s_catus* | SEQ ID NO: 143 | atgagagtttgatcctggctcaggatgaacgctggcggcgtgcttaacacatgcaagtcgaacggacgatgaagagcttgcttt tcaaagttagtggcggacgggtgagtaacgcgtgggtaacctgcctcatacaggggggatagcagctggaaacggctgataaa accgcataagcgcacagcatcgcatgatgcagtgtgaaaaactccggtggtatgagatggacccgcgtctgattagctggttg gtgaggtaacggcccaccaaggcgacgatcagtagccggcctgagagggtgaccggccacattgggactgagacacggc ccaaactcctacgggaggcagcagtggggaatattgcacaatgggggaaaccctgatgcagcgacgccgcgtgaaggaag aagtatctcggtatgtaaacttctatcagcagggaagataatgacggtacctgactaagaagccccggctaactacgtgccagc agccgcggtaatacgtagggggcaagcgttatccggatttactgggtgtaaagggagcgtaggcggcggagcaagtcagaa gtgaaagcccggggctcaaccccgggacggcttttgaaactgccctgcttgatttcaggagaggtaagcggaattcctagtgt agcggtgaaatgcgtagatattaggaggaacaccagtggcgaaggcggcttactggactgacaatgacgctgaggctcgaa agcgtggggagcaaacaggattagataccctggtagtccacgccgtaaacgatgaatactaggtgtcgggggctcataagag ctttcggtgccgcagcaaacgcaataagtattccacctggggagtacgttcgcaagaatgaaactcaaaggaattgacgggga cccgcacaagcggtggagcatgtggtttaattcgaagcaacgcgaagaaccttaccaggccttgacatcccnnn |
| *Dysgonomo nas_mossii* | SEQ ID NO: 144 | agaagagtttgatcctggctcaggatgaacgctagcgataggcctaacacatgcaagtcgaggggcagcatagagtagcaat actttgatggcgaccggcgcacgggtgagtaacacgtatgcaacctacctacatcaggggaataacccggagaaattcggac taataccgcataatacagggatgccgcatggcaatatttgttaaagatttatcggatgtagatgggcatgcgttccattagctggtt ggtaaggtaacggcttaccaaggcaacgatggatagggggaactgagaggtttgtcccccacactggaactgagacacggac cagactcctacgggaggcagcagtgaggaatattggtcaatggacgagagtctgaaccagccaaatcgcgtgaaggaagac tgccctacgggttgtaaacttcttttgtacaggaataaaagacattacgtgtagtgtattgcatgtactgtacgaataagcatcggct |

TABLE 5-continued

Full length 16S rDNA sequences of species (negative correlates)

| Species Name | Sequence Identifier | 16S rDNA sequence |
|---|---|---|
| | | aactccgtgccagcagccgcggtaatacggaggatgcgagcgttatccggatttattgggtttaaagggtgcgcaggcgggat<br>tttaagtcagcggtgaaattttcaggctcaacctgaacactgccgttgaaactgggattcttgagtatggatgaagtaggcggaat<br>tcgttgtgtagcggtgacatgcttagatataacgaggaactccgattgcgtaggcagcttactaagccataactgacgctcaagc<br>acgaaagcgtggggatcaaacaggattagataccctggtagtccacgccgtaaacgatgattactagttgtttgcgatataccgt<br>aagtgactaagcgaaagcgataagtaatccacctggggagtacgccggcaacggtgaaactcaaaggaattgacgggggc<br>ccgcacaagcggaggaacatgtggtttaattcgatgatacgcgaggaaccttacccgggcttgaaatgtacctgaccgtccttg<br>aaaggggacttctagcaatagcaggtatgtaggtgctgcatggttgtcgtcagctcgtgccgtgaggtgtcggcttaagtgccat<br>aacgagcgcaacccacattattagttactaacaggttaagctgaggactctaataagactgccgtcgtaagatgcgaggaaggt<br>gtggatgacgtcaaatcagcacggcccttacgtccggggcgacacacgtgttacaatgggaggtacaaagggctgctacctg<br>gtgacaggatgctaatccccaaagcctctcccagttcggatcggagtctgcaactcgactccgtgaagctggattcgctagtaa<br>tcgcgcatcagccatggcgcggtgaatacgttcccgggccttgtacacaccgcccgtcaagccatgggagccgggggtatct<br>gaagtgcgtaaccgtaaggagcgtcctagggtaaaactggtgactggggctaagtcgtaacaaggtagccgtaccggaaggt<br>gcggctggaacacctcctt |
| *Lachnospira ceae_bacteri um_1_4_56* FAA | SEQ ID NO: 145 | aacgagagtttgatcctggctcaggatgaacgctggcggcgtgcttaacacatgcaagtcgaacgaagcactttaccggatttc<br>ttcgggatgaaagttttgtgactgagtggcggacgggtgagtaacgcgtgggtaacctgcctcatacaggggggataacagtta<br>gaaatgactgctaataccgcataagaccacaggattgcatgatccggtggtaaaaactccggtggtatgagatggacccgcgt<br>ctgattagctagttggtaaggtaacggcttaccaaggcgacgatcagtagccgacctgagagggtgaccggccacattggga<br>ctgagacacggcccaaactcctacgggaggcagcagtggggaatattgcacaatgggggaaaccctgatgcagcgacgcc<br>gcgtgagcgatgaagtatttcggtatgtaaagctctatcagcagggaagaaaatgacggtacctgactaagaagcaccggcta<br>aatacgtgccagcagccgcggtaatacgtatggtgcaagcgttatccggatttactgggtgtaaagggagcgtagacggaga<br>ggcaagtctgatgtgaaaacccggggctcaaccccgggactgcattggaaactgtttttctagagtgtcggagaggtaagtgg<br>aattcctagtgtagcggtgaaatgcgtagatattaggaggaacaccagtggcgaaggcggcttactggacgatgactgacgtt<br>gaggctcgaaagcgtggggagcaaacaggattagataccctggtagtccacgccgtaaacgatgactgctaggtgtcggga<br>ggcaaagcctttcggtgccgcagcaaacgcaataagcagtccacctggggagtacgttcgcaagaatgaaactcaaaggaat<br>tgacggggacccgcacaagcggtggagcatgtggtttaattcgaagcaacgcgaagaaccttacctgcccttgacatccggct<br>gaccggcgagtaatgtcgcctttccttcgggacagccgagacaggtggtgcatggttgtcgtcagctcgtgtcgtgagatgttg<br>ggttaagtcccgcaacgagcgcaacccttatctttagtagccagcatttcggatgggcactctagagagactgccagggataac<br>ctggaggaaggtggggatgacgtcaaatcatcatgccccttatgggcagggctacacacgtgctacaatggcgtaaacaaag<br>ggaggcaagcctgcgagggtgagcaaatcccaaaaataacgtctcagttcggattgtagtctgcaactcgactacatgaagct<br>ggaatcgctagtaatcgcgaatcagaatgtcgcggtgaatacgttcccgggtcttgtacacaccgcccgtcacaccatgggag<br>ttggtaacgcccgaagtcagtgacccaaccgtaaggagggagctgccgaaggtgggaccgataactggggtgaagtcgtaa<br>caaggtagccgtatcggaaggtgcggctggatcacctccttt |
| *Lachnospira ceae_bacteri um_3_1_57* FAA_CT1 | SEQ ID NO: 146 | agagagtttgatcctggctcaggatgaacgctggcggcgtgcctaacacatgcaagtcgaacgaagttacacggaggaagttt<br>tcggatggaatcggtataacttagtggcggacgggtgagtaacgcgtgggaaacctgccctgtaccgggggataacacttag<br>aaataggtgctaataccgcataagcgcacggaaccgcatggttccgtgtgaaaaactccggtggtacaggatggtcccgcgtc<br>tgattagccagttggcagggtaacggcctaccaaagcgacgatcagtagccggcctgagagggtgaacggccacattggga<br>ctgagacacggcccaaactcctacgggaggcagcagtggggaatattgcacaatgggggaaaccctgatgcagcgacgcc<br>gcgtgagtgaagaagtatttcggtatgtaaagctctatcagcagggaagaaaatgacggtacctgactaagaagccccggcta<br>actacgtgccagcagccgcggtaatacgtagggggcaagcgttatccggatttactgggtgtaaagggagcgtagacggcat<br>ggcaagccagatgtgaaaacccagggctcaaccttgggattgcatttggaactgccaggctggagtgcaggagaggtaagc<br>ggaattcctagtgtagcggtgaaatgcgtagatattaggaggaacaccagtggcgaaggcggcttactggactgtaactgacg<br>ttgaggctcgaaagcgtggggagcaaacaggattagataccctggtagtccacgcggtaaacgatgattgctaggtgtaggtg<br>ggtatggacccatcggtgccgcagctaacgcaataagcaatccacctggggagtacgttcgcaagaatgaaactcaaaggaa<br>ttgacggggacccgcacaagcggtggagcatgtggtttaattcgaagcaacgcgaagaaccttaccaagtcttgacatccccc<br>tgaatatcttgtaaaaaagagatgccttcgggacaggggagacaggtggtgcatggttgtcgtcagctcgtgtcgtgagatgtt<br>gggttaagtcccgcaacgagcgcaacccttattatagtagccagcaggtaaggctgggcactctaaggagactgccgggga |

TABLE 5-continued

Full length 16S rDNA sequences of species (negative correlates)

| Species Name | Sequence Identifier | 16S rDNA sequence |
|---|---|---|
| | | taacccggaggaaggcggggatgacgtcaaatcatcatgccccttatgatttgggctacacacgtgctacaatggcgtaaaca aagggaagcgagacagtgatgtggagcaaatcccagaaataacgtctcagttcggattgtagtctgcaactcgactacatgaa gctggaatcgctagtaatcgcgaatcagcatgtcgcggtgaatacgttcccgggtcttgtacacaccgcccgtcacaccatgg gagttggaaatgcccgaagtctgtgacctaaccgaaagggaggagcagccgaaggcaggtctgataactggggtgaagtcg taacaaggtagccgtatcggaaggtgcggctggatcacctccttt |
| *Lachnospiraceae_bacterium_3_1_57* FAA_CT1 | SEQ ID NO: 147 | agagagtttgatcctggctcaggatgaacgctggcggcgtgcctaacacatgcaagtcgaacgaagttatatcgaggaagtttt cggatggaatcagtataacttagtggcggacgggtgagtaacgcgtgggaaacctgccctgtaccgggggataacacttaga aataggtgctaataccgcataagcgcacagcttcacatgaagcagtgtgaaaaactccggtggtacaggatggtcccgcgtct gattagccagttggcagggtaacggcctaccaaagcgacgatcagtagccggcctgagagggtgaacggccacattgggac tgagacacggcccaaactcctacgggaggcagcagtggggaatattgcacaatgggggaaaccctgatgcagcgacgccg cgtgagtgaagaagtatttcggtatgtaaagctctatcagcagggaagaaaatgacggtacctgactaagaagccccggctaa ctacgtgccagcagccgcggtaatacgtagggggcaagcgttatccggatttactgggtgtaaagggagcgtagacggcatg gcaagccagatgtgaaaacccagggctcaaccttgggattgcatttggaactgtcaggctggagtgcaggagaggtaagcgg aattcctagtgtagcggtgaaatgcgtagatattaggaggaacaccagtggcgaaggcggcttactggactgtaactgacgttg aggctcgaaagcgtggggagcaaacaggattagataccctggtagtccacgcggtaaacgatgattgctaggtgtaggtggg tatggacccatcggtgccgcagctaacgcaataagcaatccacctggggagtacgttcgcaagaatgaaactcaaaggaattg acggggacccgcacaagcggtggagcatgtggtttaattcgaagcaacgcgaagaaccttaccaagtcttgacatcccctga ctctcctgtaaaagagtgaggccttcgggacattggagacaggtggtgcatggttgtcgtcagctcgtgtcgtgagatgttgggt taagtcccgcaacgagcgcaacccttattcttagtagccagcaggtaaagctgggcactctaaggagactgccggggataacc cggaggaaggcggggatgacgtcaaatcatcatgccccttatgatttgggctacacacgtgctacaatggcgtaaacaaagg gaagcgagacagtgatgtggagcaaatcccagaaataacgtctcagttcggattgtagtctgcaactcgactacatgaagctg gaatcgctagtaatcgcgaatcagcatgtcgcggtgaatacgttcccgggtcttgtacacaccgcccgtcacaccatgggagtt ggaaatgcccgaagtctgtgacctaaccgaaagggaggagcagccgaaggcaggtctgataactggggtgaagtcgtaaca aggtagccgtatcggaaggtgcggctggatcacctccttt |
| *Lachnospiraceae_bacterium_3_1_57* FAA_CT1 | SEQ ID NO: 148 | agagagtttgatcctggctcaggatgaacgctggcggcgtgcctaacacatgcaagtcgaacgaagttacacagaggaagttt tcggatggaatcggtataacttagtggcggacgggtgagtaacgcgtgggaaacctgccctgtaccgggggataacacttag aaataggtgctaataccgcataagcgcacggattcacatgaagcagtgtgaaaaactccggtggtacaggatggtcccgcgtc tgattagccagttggcagggtaacggcctaccaaagcgacgatcagtagccggcctgagagggtgaacggccacattggga ctgagacacggcccaaactcctacgggaggcagcagtggggaatattgcacaatgggggaaaccctgatgcagcgacgcc gcgtgagtgaagaagtatttcggtatgtaaagctctatcagcagggaagaaaatgacggtacctgactaagaagccccggcta actacgtgccagcagccgcggtaatacgtagggggcaagcgttatccggatttactgggtgtaaagggagcgtagacggcat ggcaagccagatgtgaaaacccagggctcaaccttgggattgcatttggaactgtcaggctggagtgcaggagaggtaagcg gaattcctagtgtagcggtgaaatgcgtagatattaggaggaacaccagtggcgaaggcggcttactggactgtaactgacgtt gaggctcgaaagcgtggggagcaaacaggattagataccctggtagtccacgcggtaaacgatgattgctaggtgtaggtgg gtatggacccatcggtgccgcagctaacgcaataagcaatccacctggggagtacgttcgcaagaatgaaactcaaaggaatt gacggggacccgcacaagcggtggagcatgtggtttaattcgaagcaacgcgaagaaccttaccaagtcttgacatcccaat gacgcacctgtaaagaggtgttcccttcggggcattggagacaggtggtgcatggttgtcgtcagctcgtgtcgtgagatgttg ggttaagtcccgcaacgagcgcaacccttattcttagtagccagcaggtaaagctgggcactctaaggagactgccggggata acccggaggaaggcggggatgacgtcaaatcatcatgccccttatgatttgggctacacacgtgctacaatggcgtaaacaaa gggaagcgagacagtgatgtggagcaaatcccagaaataacgtctcagttcggattgtagtctgcaactcgactacatgaagc tggaatcgctagtaatcgcgaatcagcatgtcgcggtgaatacgttcccgggtcttgtacacaccgcccgtcacaccatggga gttggaaatgcccgaagtctgtgacctaaccgaaagggaggagcagccgaaggcaggtctgataactggggtgaagtcgta acaaggtagccgtatcggaaggtgcggctggatcacctccttt |

TABLE 5-continued

Full length 16S rDNA sequences of species (negative correlates)

| Species Name | Sequence Identifier | 16S rDNA sequence |
|---|---|---|
| *Lachnospiraceae_bacterium_5_1_57* FAA | SEQ ID NO: 149 | aacgagagtttgatcctggctcaggatgaacgctggcggcgtgcctaacacatgcaagtcgaacgaagcgcctggccccga<br>cttcttcggaacgaggagccttgcgactgagtggcggacgggtgagtaacgcgtgggcaacctgccttgcactgggggataa<br>cagccagaaatggctgctaataccgcataagaccgaagcgccgcatggcgcggcggccaaagccccggcggtgcaagat<br>gggcccgcgtctgattaggtagttggcggggtaacggcccaccaagccgacgatcagtagccgacctgagagggtgaccg<br>gccacattgggactgagacacggcccagactcctacgggaggcagcagtggggaatattgcacaatgggggaaaccctgat<br>gcagcgacgccgcgtgaaggatgaagtatttcggtatgtaaacttctatcagcagggaagaagatgacggtacctgactaaga<br>agccccggctaactacgtgccagcagccgcggtaatacgtagggggcaagcgttatccggatttactgggtgtaaagggagc<br>gtagacggcgatgcaagccagatgtgaaagcccggggctcaaccccgggactgcatttggaactgcgtggctggagtgtcg<br>gagaggcaggcggaattcctagtgtagcggtgaaatgcgtagatattaggaggaacaccagtggcgaaggcggcctgctgg<br>acgatgactgacgttgaggctcgaaagcgtggggagcaaacaggattagataccctggtagtccacgccgtaaacgatgact<br>actaggtgtcgggtggcaaggccattcggtgccgcagcaaacgcaataagtagtccacctggggagtacgttcgcaagaatg<br>aaactcaaaggaattgacggggacccgcacaagcggtggagcatgtggtttaattcgaagcaacgcgaagaaccttacctga<br>tcttgacatcccgatgccaaagcgcgtaacgcgctctttcttcggaacatcggtgacaggtggtgcatggttgtcgtcagctcgt<br>gtcgtgagatgttgggttaagtcccgcaacgagcgcaacccctatcttcagtagccagcattatggatgggcactctggagaga<br>ctgccagggagaacctggaggaaggtggggatgacgtcaaatcatcatgccccttatgaccagggctacacacgtgctacaa<br>tggcgtaaacaaagggaggcgaacccgcgagggtgggcaaatcccaaaaataacgtctcagttcggattgtagtctgcaact<br>cgactacatgaagctggaatcgctagtaatcgcgaatcagaatgtcgcggtgaatacgttcccgggtatgtacacaccgcccg<br>tcacaccatgggagtcagtaacgcccgaagccggtgacccaacccgtaagggagggagccgtcgaaggtgggaccgataa<br>ctggggtgaagtcgtaacaaggtagccgtatcggaaggtgcggctggatcacctccttt |
| *Lachnospiraceae_bacterium_1_1_57* FAA | SEQ ID NO: 150 | aacgagagtttgatcctggctcaggatgaacgctggcggcgtgcctaacacatgcaagtcgagcgaagcactttgatagattc<br>ttcggatgaagaggattgtgactgagcggcggacgggtgagtaacgcgtgggtaacctgcctcatacagggggataacagtt<br>agaaatgactgctaataccgcataagaccacagcaccgcatggtgcgggggtaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcagggaagaaaatgacggtacctgactaagaagcaccgg<br>ctaaatacgtgccagcagccgcggtaatacgtatggtgcaagcgttatccggatttactgggtgtaaagggagcgtagacgga<br>tgggcaagtctgatgtgaaaacccggggctcaaccccgggactgcattggaaactgttcatctagagtgctggagaggtaagt<br>ggaattcctagtgtagcggtgaaatgcgtagatattaggaggaacaccagtggcgaaggcggcttactggacagtaactgac<br>gttgaggctcgaaagcgtggggagcaaacaggattagataccctggtagtccacgccgtaaacgatgactactaggtgtcgg<br>gtggcaaagccattcggtgccgcagcaaacgcaataagtagtccacctggggagtacgttcgcaagaatgaaactcaaagga<br>attgacggggacccgcacaagcggtggagcatgtggtttaattcgaagcaacgcgaagaaccttacctgctcttgacatcccg<br>ctgaccggacggtaatgcgtccttcccttcggggcagcggagacaggtggtgcatggttgtcgtcagctcgtgtcgtgagatgt<br>tgggttaagtcccgcaacgagcgcaacccctatctttagtagccagcggccaggccgggcactctagagagactgccgggg<br>ataacccggaggaaggtggggatgacgtcaaatcatcatgccccttatgagcagggctacacacgtgctacaatggcgtaaa<br>caaagggaagcgagaccgcgaggtggagcaaatcccaaaaataacgtctcagttcggattgtagtctgcaactcgactacatg<br>aagctggaatcgctagtaatcgcgaatcagaatgtcgcggtgaatacgttcccgggtcttgtacacaccgcccgtcacaccatg<br>ggagtcagtaacgcccgaagtcagtgacccaaccgtaaggagggagagccgaaggcgggaccgataactggggtgaagt<br>cgtaacaaggtagccgtatcggaaggtgcggctggatcacctccttt |
| *Lachnospiraceae_bacterium_2_1_58* FAA | SEQ ID NO: 151 | aacgagagtttgatcctggctcaggatgaacgctggcggcgtgcttaacacatgcaagtcgagcgaagcaccttgacggattt<br>cttcggattgaagccttggtgactgagcggcggacgggtgagtaacgcgtgggtaacctgcctcatacagggggataacagtt<br>ggaaacggctgctaataccgcataagcgcacagtaccgcatggtacggtgtgaaaaactccggtggtatgagatggacccgc<br>gtctgattaggtagttggtggggtaacggcctaccaagccgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgatgaagtatttcggtatgtaaagctctatcagcagggaagaaaatgacggtacctgactaagaagccccggc<br>taactacgtgccagcagccgcggtaatacgtagggggcaagcgttatccggatttactgggtgtaaagggagcgtagacggc |

TABLE 5-continued

Full length 16S rDNA sequences of species (negative correlates)

| Species Name | Sequence Identifier | 16S rDNA sequence |
|---|---|---|
| | | atggcaagccagatgtgaaagcccggggctcaaccccgggactgcatttggaactgtcaggctagagtgtcggagaggaaa<br>gcggaattcctagtgtagcggtgaaatgcgtagatattaggaggaacaccagtggcgaaggcggctttctggacgatgactga<br>cgttgaggctcgaaagcgtggggagcaaacaggattagataccctggtagtccacgccgtaaacgatgaatactaggtgtcg<br>ggtggcaaagccattcggtgccgcagcaaacgcaataagtattccacctggggagtacgttcgcaagaatgaaactcaaagg<br>aattgacggggacccgcacaagcggtggagcatgtggtttaattcgaagcaacgcgaagaaccttacctggtcttgacatccc<br>tctgaccgctctttaatcggagctttccttcgggacagaggagacaggtggtgcatggttgtcgtcagacgtgtcgtgagatgtt<br>gggttaagtcccgcaacgagcgcaacccctatctttagtagccagcattttcggatgggcactctagagagactgccagggat<br>aacctggaggaaggtggggatgacgtcaaatcatcatgccccttatgaccagggctacacacgtgctacaatggcgtaaacaa<br>agggaagcgagcccgcgagggggagcaaatcccaaaaataacgtctcagttcggattgtagtctgcaactcgactacatgaa<br>gctggaatcgctagtaatcgcgaatcagaatgtcgcggtgaatacgttcccgggtcttgtacacaccgcccgtcacaccatgg<br>gagtcagtaacgcccgaagtcagtgacccaaccgcaaggagggagctgccgaaggtgggaccgataactggggtgaagtc<br>gtaacaaggtagccgtatcggaaggtgcggctggatcacctccttt |
| *Roseburia_hominis* | SEQ ID NO: 152 | atgagagtttgatcctggctcaggatgaacgctggcggcgtgcttaacacatgcaagtcgaacgaagcactttaattgatttcttc<br>ggaatgaagtttttgtgactgagtggcggacgggtgagtaacgcgtgggtaacctgcctcatacagggggataacagttggaa<br>acgactgctaataccgcataagcgcacaggattgcatgatccagtgtgaaaaactccggtggtatgagatggacccgcgtctg<br>attagccagttggcggggtaacggcccaccaaagcgacgatcagtagccgacctgagagggtgaccggccacattgggact<br>gagacacggcccaaactcctacgggaggcagcagtggggaatattgcacaatgggggaaaccctgatgcagcgacgccgc<br>gtgagcgaagaagtatttcggtatgtaaagctctatcagcagggaagaagaatgacggtacctgactaagaagcaccggctaa<br>atacgtgccagcagccgcggtaatacgtatggtgcaagcgttatccggatttactgggtgtaaagggagcgcaggcggtacg<br>gcaagtctgatgtgaaatcccggggctcaaccccggtactgcattggaaactgtcggactagagtgtcggaggggtaagtgg<br>aattcctagtgtagcggtgaaatgcgtagatattaggaggaacaccagtggcgaaggcggcttactggacgattactgacgct<br>gaggctcgaaagcgtggggagcaaacaggattagataccctggtagtccacgccgtaaacgatgaatactaggtgtcgggg<br>agcattgctcttcggtgccgcagcaaacgcaataagtattccacctggggagtacgttcgcaagaatgaaactcaaaggaattg<br>acggggacccgcacaagcggtggagcatgtggtttaattcgaagcaacgcgaagaaccttaccaagtcttgacatcccactga<br>caaagtatgtaatgtactttctcttcggagcagtggtgacaggtggtgcatggttgtcgtcagctcgtgtcgtgagatgttgggtta<br>agtcccgcaacgagcgcaacccctattcttagtagccagcggttcggccgggcactctagggagactgccagggataacctg<br>gaggaaggtggggatgacgtcaaatcatcatgccccttatgacttgggctacacacgtgctacaatggcgtaaacaaagggaa<br>gcaatcccgcgagggggagcaaatctcaaaaataacgtctcagttcggactgtagtctgcaactcgactacacgaagctggaa<br>tcgctagtaatcgcgaatcagaatgtcgcggtgaatacgttcccgggtcttgtacacaccgcccgtcacaccatgggagttggt<br>aatgcccgaagtcagtgacccaaccgcaaggagggagctgccgaaggcaggactgataactggggtgaagtcgtaacaag<br>gtagccgtatcggaaggtgcggctggatcacctccttt |
| *Roseburia_hominis* | SEQ ID NO: 153 | atgagagtttgatcctggctcaggatgaacgctggcggcgtgcttaacacatgcaagtcgaacgaagcactttaattgatttcttc<br>ggaatgaagtttttgtgactgagtggcggacgggtgagtaacgcgtgggtaacctgcctcatacagggggataacagttggaa<br>acgactgctaataccgcataagcgcacaggattgcatgatccagtgtgaaaaactccggtggtatgagatggacccgcgtctg<br>attagccagttggcggggtaacggcccaccaaagcgacgatcagtagccgacctgagagggtgaccggccacattgggact<br>gagacacggcccaaactcctacgggaggcagcagtggggaatattgcacaatgggggaaaccctgatgcagcgacgccgc<br>gtgagcgaagaagtatttcggtatgtaaagctctatcagcagggaagaagaatgacggtacctgactaagaagcaccggctaa<br>atacgtgccagcagccgcggtaatacgtatggtgcaagcgttatccggatttactgggtgtaaagggagcgcaggcggtacg<br>gcaagtctgatgtgaaatcccggggctcaaccccggtactgcattggaaactgtcggactagagtgtcggaggggtaagtgg<br>aattcctagtgtagcggtgaaatgcgtagatattaggaggaacaccagtggcgaaggcggcttactggacgattactgacgct<br>gaggctcgaaagcgtggggagcaaacaggattagataccctggtagtccacgccgtaaacgatgaatactaggtgtcgggg<br>agcattgctcttcggtgccgcagcaaacgcaataagtattccacctggggagtacgttcgcaagaatgaaactcaaaggaattg<br>acggggacccgcacaagcggtggagcatgtggtttaattcgaagcaacgcgaagaaccttaccaagtcttgacatcccactga<br>cagagtatgtaatgtactttctcttcggagcagtggtgacaggtggtgcatggttgtcgtcagctcgtgtcgtgagatgttgggtta<br>agtcccgcaacgagcgcaacccctattcttagtagccagcggttcggccgggcactctagggagactgccagggataacctg<br>gaggaaggtggggatgacgtcaaatcatcatgccccttatgacttgggctacacacgtgctacaatggcgtaaacaaagggaa |

TABLE 5-continued

| Species Name | Sequence Identifier | 16S rDNA sequence |
|---|---|---|
| | | gcaatcccgcgagggggagcaaatctcaaaaataacgtctcagttcggactgtagtctgcaactcgactacacgaagctggaa<br>tcgctagtaatcgcgaatcagaatgtcgcggtgaatacgttcccgggtcttgtacacaccgcccgtcacaccatgggagttggt<br>aatgcccgaagtcagtgacccaaccgcaaggagggagctgccgaaggcaggactgataactggggtgaagtcgtaacaag<br>gtagccgtatcggaaggtgcggctggatcacctccttt |
| *Roseburia_hominis* | SEQ ID NO: 154 | atgagagtttgatcctggctcaggatgaacgctggcggcgtgcttaacacatgcaagtcgaacgaagcactttaattgatttcttc<br>ggaatgaagtttttgtgactgagtggcggacgggtgagtaacgcgtgggtaacctgcctcatacagggggataacagttggaa<br>acgactgctaataccgcataagcgcacaggattgcatgatccagtgtgaaaaactccggtggtatgagatggacccgcgtctg<br>attagccagttggcggggtaacggcccaccaaagcgacgatcagtagccgacctgagagggtgaccggccacattgggact<br>gagacacggcccaaactcctacgggaggcagcagtggggaatattgcacaatgggggaaaccctgatgcagcgacgccgc<br>gtgagcgaagaagtatttcggtatgtaaagctctatcagcagggaagaagaatgacggtacctgactaagaagcaccggctaa<br>atacgtgccagcagccgcggtaatacgtatggtgcaagcgttatccggatttactgggtgtaaagggagcgcaggcggtacg<br>gcaagtctgatgtgaaatcccggggctcaaccccggtactgcattggaaactgtcggactagagtgtcggaggggtaagtgg<br>aattcctagtgtagcggtgaaatgcgtagatattaggaggaacaccagtggcgaaggcggcttactggacgattactgacgct<br>gaggctcgaaagcgtggggagcaaacaggattagataccctggtagtccacgccgtaaacgatgaatactaggtgtcgggg<br>agcattgctcttcggtgccgcagcaaacgcaataagtattccacctggggagtacgttcgcaagaatgaaactcaaaggaattg<br>acggggacccgcacaagcggtggagcatgtggtttaattcgaagcaacgcgaagaaccttaccaagtcttgacatcccactga<br>cagagtatgtaatgtactttctcttcggagcagtggtgacaggtggtgcatggttgtcgtcagctcgtgtcgtgagatgttgggtta<br>agtcccgcaacgagcgcaacccctattcttagtagccagcggttcggccgggcactctagggagactgccagggataacctg<br>gaggaaggtggggatgacgtcaaatcatcatgccccttatgacttgggctacacacgtgctacaatggcgtaaacaaagggaa<br>gcaatcccgcgagggggagcaaatctcaaaaataacgtctcagttcggactgtagtctgcaactcgactacacgaagctggaa<br>tcgctagtaatcgcgaatcagaatgtcgcggtgaatacgttcccgggtcttgtacacaccgcccgtcacaccatgggagttggt<br>aatgcccgaagtcagtgacccaaccgcaaggagggagctgccgaaggcaggactgataactggggtgaagtcgtaacaag<br>gtagccgtatcggaaggtgcggctggatcacctccttt |
| *Roseburia_hominis* | SEQ ID NO: 155 | atgagagtttgatcctggctcaggatgaacgctggcggcgtgcttaacacatgcaagtcgaacgaagcactttaattgatttcttc<br>ggaatgaagtttttgtgactgagtggcggacgggtgagtaacgcgtgggtaacctgcctcatacagggggataacagttggaa<br>acgactgctaataccgcataagcgcacaggattgcatgatccggtgtgaaaaactccggtggtatgagatggacccgcgtctg<br>attagccagttggcggggtaacggcccaccaaagcgacgatcagtagccgacctgagagggtgaccggccacattgggact<br>gagacacggcccaaactcctacgggaggcagcagtggggaatattgcacaatgggggaaaccctgatgcagcgacgccgc<br>gtgagcgaagaagtatttcggtatgtaaagctctatcagcagggaagaagaatgacggtacctgactaagaagcaccggctaa<br>atacgtgccagcagccgcggtaatacgtatggtgcaagcgttatccggatttactgggtgtaaagggagcgcaggcggtacg<br>gcaagtctgatgtgaaatcccggggctcaaccccggtactgcattggaaactgtcggactagagtgtcggaggggtaagtgg<br>aattcctagtgtagcggtgaaatgcgtagatattaggaggaacaccagtggcgaaggcggcttactggacgattactgacgct<br>gaggctcgaaagcgtggggagcaaacaggattagataccctggtagtccacgccgtaaacgatgaatactaggtgtcgggg<br>agcattgctcttcggtgccgcagcaaacgcaataagtattccacctggggagtacgttcgcaagaatgaaactcaaaggaattg<br>acggggacccgcacaagcggtggagcatgtggtttaattcgaagcaacgcgaagaaccttaccaagtcttgacatcccactga<br>cagagtatgtaatgtactttctcttcggagcagtggtgacaggtggtgcatggttgtcgtcagctcgtgtcgtgagatgttgggtta<br>agtcccgcaacgagcgcaacccctattcttagtagccagcggttcggccgggcactctagggagactgccagggataacctg<br>gaggaaggtggggatgacgtcaaatcatcatgccccttatgacttgggctacacacgtgctacaatggcgtaaacaaagggaa<br>gcaatcccgcgagggggagcaaatctcaaaaataacgtctcagttcggactgtagtctgcaactcgactacacgaagctggaa<br>tcgctagtaatcgcgaatcagaatgtcgcggtgaatacgttcccgggtcttgtacacaccgcccgtcacaccatgggagttggt<br>aatgcccgaagtcagtgacccaaccgcaaggagggagctgccgaaggcaggactgataactggggtgaagtcgtaacaag<br>gtagccgtatcggaaggtgcggctggatcacctccttt |

Full length 16S rDNA sequences of species (negative correlates)

TABLE 5-continued

Full length 16S rDNA sequences of species (negative correlates)

| Species Name | Sequence Identifier | 16S rDNA sequence |
|---|---|---|
| *Erysipelotric haceae_bact erium_2_2_* 44A | SEQ ID NO: 156 | atggagagtttgatcctggctcaggatgaacgctggcggcatgcctaatacatgcaagtcgaacgaagcttcaggaagcttgct<br>tccaaagagacttagtggcgaacgggtgagtaacacgtaggtaacctgcccatgtgtccgggataactgctggaaacggtag<br>ctaaaaccggataggtatacagagcgcatgctcagtatattaaagcgcccatcaaggcgtgaacatggatggacctgcggcg<br>cattagctagttggtgaggtaacggcccaccaaggcgatgatgcgtagccggcctgagagggtaaacggccacattgggact<br>gagacacggcccaaactcctacgggaggcagcagtagggaattttcgtcaatgggggaaaccctgaacgagcaatgccgc<br>gtgagtgaagaaggtcttcggatcgtaaagctctgttgtaagtgaagaacggctcatagaggaaatgctatgggagtgacggt<br>agcttaccagaaagccacggctaactacgtgccagcagccgcggtaatacgtaggtggcaagcgttatccggaatcattggg<br>cgtaaagggtgcgtaggtggcgtactaagtctgtagtaaaaggcaatggctcaaccattgtaagctatggaaactggtatgctg<br>gagtgcagaagagggcgatggaattccatgtgtagcggtaaaatgcgtagatatatggaggaacaccagtggcgaaggcgg<br>tcgcctggtctgtaactgacactgaggcacgaaagcgtggggagcaaataggattagataccctagtagtccacgccgtaaac<br>gatgagaactaagtgttggaggaattcagtgctgcagttaacgcaataagttctccgcctggggagtatgcacgcaagtgtgaa<br>actcaaaggaattgacgggggcccgcacaagcggtggagtatgtggtttaattcgaagcaacgcgaagaaccttaccaggcc<br>ttgacatggaaacaaataccctagagatagggggataattatggatcacacaggtggtgcatggttgtcgtcagctcgtgtcgtg<br>agatgttgggttaagtcccgcaacgagcgcaacccttgtcgcatgttaccagcatcaagttggggactcatgcgagactgccg<br>gtgacaaaccggaggaaggtggggatgacgtcaaatcatcatgcccttatggcctgggctacacacgtactacaatggcga<br>ccacaaagagcagcgacttggtgacaagaagcgaatctcataaaggtcgtctcagttcggattgaagtctgcaactcgacttca<br>tgaagtcggaatcgctagtaatcgcagatcagcatgctgcggtgaatacgttctcgggccttgtacacaccgcccgtcaaacca<br>tgggagtcagtaatacccgaagccggtggcataaccgtaaggagtgagccgtcgaaggtaggaccgatgactggggttaag<br>tcgtaacaaggtatccctacgggaacgtggggatggatcacctccttt |
| *Clostridium _citroniae* | SEQ ID NO: 157 | tttgagagtttgatcctggctcaggatgaacgctggcggcgtgcctaacacatgcaagtcgaacgaagcaatcagaatgaaatt<br>ttcggatggatttctggttgactgagtggcggacgggtgagtaacgcgtggataacctgcctcacactgggggataacagttag<br>aaatggctgctaataccgcataagcgcacagtaccgcatggtacggtgtgaaaaactccggtggtgtgagatggatccgcgtc<br>tgattagttagaggcggggtaacggcccaccaagacagcgatcagtagccgacctgagagggtgaccggccacattggga<br>ctgagacacggcccaaactcctacgggaggcagcagtggggaatattgcacaatgggcgaaagcctgatgcagcgacgcc<br>gcgtgagtgaagaagtatttcggtatgtaaagctctatcagcagggaagaaaatgacggtacctgactaagaagccccggcta<br>actacgtgccagcagccgcggtaatacgtagggggcaagcgttatccggatttactgggtgtaaagggagcgtagacggcg<br>aagcaagtctgaagtgaaaacccagggctcaaccctgggactgctttggaaactgttttgctagagtgtcggagaggtaagtg<br>gaattcctagtgtagcggtgaaatgcgtagatattaggaggaacaccagtggcgaaggcggcttactggacgataactgacgt<br>tgaggctcgaaagcgtggggagcaaacaggattagataccctggtagtccacgccgtaaacgatgaatgctaggtgttgggg<br>ggcaaagcccttcggtgccgtcgcaaacgcaataagcattccacctggggagtacgttcgcaagaatgaaactcaaaggaatt<br>gacggggacccgcacaagcggtggagcatgtggtttaattcgaagcaacgcgaagaaccttaccaagtcttgacatccccct<br>gaccggtcagtaaagtgacctttccttcgggacaggggagacaggtggtgcatggttgtcgtcagctcgtgtcgtgagatgttg<br>ggttaagtcccgcaacgagcgcaacccttatccttagtagccagcaggtaaagctgggcactctagggagactgccagggat<br>aacctggaggaaggtggggatgacgtcaaatcatcatgccccttatgatttgggctacacacgtgctacaatggcgtaaacaaa<br>gggaagcgaccctgcgaaggcaagcaaatcccaaaaataacgtcccagttcggactgtagtctgcaacccgactacacgaa<br>gctggaatcgctagtaatcgcgaatcagaatgtcgcggtgaatacgttcccgggtcttgtacacaccgcccgtcacaccatgg<br>gagtcagcaacgcccgaannnnn |
| *Flavonifract or_plautii* | SEQ ID NO: 158 | tattgagagtttgatcctggctcaggatgaacgctggcggcgtgcttaacacatgcaagtcgaacggggtgctcatgacggag<br>gattcgtccaatggattgagttacctagtggcggacgggtgagtaacgcgtgaggaacctgccttggagaggggaataacact<br>ccgaaaggagtgctaataccgcatgaagcagttgggtcgcatggctctgactgccaaagatttatcgctctgagatggcctcgc<br>gtctgattagctagtaggcggggtaacggcccacctaggcgacgatcagtagccggactgagaggttgaccggccacattgg<br>gactgagacacggcccagactcctacgggaggcagcagtggggaatattgggcaatgggcgcaagcctgacccagcaac<br>gccgcgtgaaggaagaaggctttcgggttgtaaacttcttttgtcggggacgaaacaaatgacggtacccgacgaataagcca<br>cggctaactacgtgccagcagccgcggtaatacgtaggtggcaagcgttatccggatttactgggtgtaaagggcgtgtaggc<br>gggattgcaagtcagatgtgaaaactgggggctcaacctccagcctgcatttgaaactgtagttcttgagtgctggagaggcaa |

TABLE 5-continued

Full length 16S rDNA sequences of species (negative correlates)

| Species Name | Sequence Identifier | 16S rDNA sequence |
|---|---|---|
| | | tcggaattccgtgtgtagcggtgaaatgcgtagatatacggaggaacaccagtggcgaaggcggattgctggacagtaactg<br>acgctgaggcgcgaaagcgtggggagcaaacaggattagataccctggtagtccacgccgtaaacgatggatactaggtgt<br>ggggggtctgacccctccgtgccgcagttaacacaataagtatcccacctggggagtacgatcgcaaggttgaaactcaaa<br>ggaattgacgggggcccgcacaagcggtggagtatgtggtttaattcgaagcaacgcgaagaaccttaccagggcttgacat<br>cccactaacgaggcagagatgcgttaggtgcccttcggggaaagtggagacaggtggtgcatggttgtcgtcagctcgtgtc<br>gtgagatgttgggttaagtcccgcaacgagcgcaacccttattgttagttgctacgcaagagcactctagcgagactgccgttg<br>acaaaacggaggaaggtggggacgacgtcaaatcatcatgccccttatgtcctgggccacacacgtactacaatggtggttaa<br>cagagggaggcaataccgcgaggtggagcaaatccctaaaagccatcccagttcggattgcaggctgaaacccgcctgtatg<br>aagttggaatcgctagtaatcgcggatcagcatgccgcggtgaatacgttcccgggccttgtacacaccgcccgtcacaccat<br>gagagtcgggaacacccgaagtccgtagcctaaccgcaaggagggcgcggccgaaggtgggttcgataattggggtgaag<br>tcgtaacaaggtagccgtatcggaaggtgcggctggatcacctccttt |
| *Lachnospiraceae_bacterium_7_1_58FAA* | SEQ ID NO: 159 | tattgagagtttgatcctggctcaggatgaacgctggcggcgtgcttaacacatgcaagtcgaacggggtgctcatgacggag<br>gattcgtccaacggattgagttacctagtggcggacgggtgagtaacgcgtgaggaacctgccttggagaggggaataacac<br>tccgaaaggagtgctaataccgcatgatgcagttgggtcgcatggctctgactgccaaagatttatcgctctgagatggcctcg<br>cgtctgattagctagtaggcggggtaacggcccacctaggcgacgatcagtagccggactgagaggttgaccggccacattg<br>ggactgagacacggcccagactcctacgggaggcagcagtggggaatattgggcaatgggcgcaagcctgacccagcaa<br>cgccgcgtgaaggaagaaggctttcgggttgtaaacttcttttgtcggggacgaaacaaatgacggtacccgacgaataagcc<br>acggctaactacgtgccagcagccgcggtaatacgtaggtggcaagcgttatccggatttactgggtgtaaagggcgtgtagg<br>cgggattgcaagtcagatgtgaaaactgggggctcaacctccagcctgcatttgaaactgtagttcttgagtgctggagaggca<br>atcggaattccgtgtgtagcggtgaaatgcgtagatatacggaggaacaccagtggcgaaggcggattgctggacagtaact<br>gacgctgaggcgcgaaagcgtggggagcaaacaggattagataccctggtagtccacgccgtaaacgatggatactaggtg<br>tggggggtctgacccctccgtgccgcagttaacacaataagtatcccacctggggagtacgatcgcaaggttgaaactcaaa<br>ggaattgacgggggcccgcacaagcggtggagtatgtggtttaattcgaagcaacgcgaagaaccttaccagggcttgacat<br>cccactaacgaagcagagatgcattaggtgcccttcggggaaagtggagacaggtggtgcatggttgtcgtcagctcgtgtcg<br>tgagatgttgggttaagtcccgcaacgagcgcaacccttattgttagttgctacgcaagagcactctagcgagactgccgttgac<br>aaaacggaggaaggtggggacgacgtcaaatcatcatgccccttatgtcctgggccacacacgtactacaatggtggttaaca<br>gagggaggcaataccgcgaggtggagcaaatccctaaaagccatcccagttcggattgcaggctgaaacccgcctgtatgaa<br>gttggaatcgctagtaatcgcggatcagcatgccgcggtgaatacgttcccgggccttgtacacaccgcccgtcacaccatga<br>gagtcgggaacacccgaagtccgtagcctaaccgcaaggagggcgcggccgaaggtgggttcgataattggggtgaagtc<br>gtaacaaggtagccgtatcggaaggtgcggctggatcacctccttt |
| *Erysipelotrichaceae_bacterium_6_1_45* | SEQ ID NO: 160 | atggagagtttgatcctggctcaggatgaacgctggcggcatgcctaatacatgcaagtcgaacgaagtttcgaggaagcttg<br>cttccaaagagacttagtggcgaacgggtgagtaacacgtaggtaacctgcccatgtgtccgggataactgctggaaacggta<br>gctaaaaccggataggtatacagagcgcatgctcagtatattaaagcgnnnnnnnnnnnnnnnnnnnnnnnnnnnnnnn<br>nnnnnnnnnnnnnnnnnnnnnnnnnnnnnnnnnnnnnnnnnnnnnnnnnnnnnnnnnnnnnnnnnnnnnng<br>aggtaacggctcaccaaggcgatgatgcgtagccggcctgagagggtaaacggccacattgggactgagacacggcccaa<br>actcctacgggaggcagcagtagggaattttcgtcaatgggggaaaccctgaacgagcaatgccgcgtgagtgaagaaggt<br>cttcggatcgtaaagctctgttgtaagtgaagaacggatcatagaggaaatgctatgggagtgacggtagcttaccagaaagcc<br>acggctaactacgtgccagcagccgcggtaatacgtaggtggcaagcgttatccggaatcattgggcgtaaagggtgcgtag<br>gtggcgtactaagtctgtagtaaaaggcaatggctcaaccattgtaagctatggaaactggtatgctggagtgcagaagaggg<br>cgatggaattccatgtgtagcggtaaaatgcgtagatatatggaggaacaccagtggcgaaggcggtcgcctggtctgtaact<br>gacactgaggcacgaaagcgtggggagcaaataggattagataccctagtagtccacgccgtaaacgatgagaactaagtgt<br>tggaggaattcagtgctgcagttaacgcaataagttctccgcctggggagtatgcacgcaagtgtgaaactcaaaggaattgac<br>gggggcccgcacaagcggtggagtatgtggtttaattcgaagcaacgcgaagaaccttaccaggccttgacatggaaacaaa<br>taccctagagatagggggataattatggatcacacaggtggtgcatggttgtcgtcagctcgtgtcgtgagatgttgggttaagt<br>cccgcaacgagcgcaacccttgtcgcatgttaccagcatcaagttggggactcatgcgagactgccggtgacaaaccggagg<br>aaggtggggatgacgtcaaatcatcatgccccttatggcctgggctacacacgtactacaatggcggccacaaagagcagcg |

TABLE 5-continued

Full length 16S rDNA sequences of species (negative correlates)

| Species Name | Sequence Identifier | 16S rDNA sequence |
| --- | --- | --- |
| | | acacagtgatgtgaagcgaatctcataaaggtcgtctcagttcggattgaagtctgcaactcgacttcatgaagtcggaatcgct agtaatcgcagatcagcatgctgcggtgaatacgttctcgggccttgtacacaccgcccgtcaaaccatgggagtcagtaatac ccgaagccggtggcataaccgtaaggagtgagccgtcgaaggtaggaccgatgactggggttaagtcgtaacaaggtatcc ctacgggaacgtggggatggatcacctccttt |
| *Erysipelotrichaceae_bacterium_6_1_*45 | SEQ ID NO: 161 | atggagagtttgatcctggctcaggatgaacgctggcggcatgcctaatacatgcaagtcgaacgaagtttcgaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgtccatcaaggcgtgaacatggatggacctgcggcg cattagctagttggtgaggtaacggctcaccaaggcgatgatgcgtagccggcctgagagggtaaacggccacattgggact gagacacggcccaaactcctacgggaggcagcagtagggaattttcgtcaatggggggaaccctgaacgagcaatgccgc gtgagtgaagaaggtcttcggatcgtaaagctctgttgtaagtgaagaacggctcatagaggaaatgctatgggagtgacggt agcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcttggggagtatgcacgcaagtgtgaa actcaaaggaattgacgggggcccgcacaagcggtggagtatgtggtttaattcgaagcaacgcgaagaaccttaccaggcc ttgacatggaaacaaataccctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcgg ccacaaagagcagcgacacagtgatgtgaagcgaatctcataaaggtcgtctcagttcggattgaagtctgcaactcgacttca tgaagtcggaatcgctagtaatcgcagatcagcatgctgcggtgaatacgactcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctccttt |
| *Erysipelotrichaceae_bacterium_6_1_*45 | SEQ ID NO: 162 | atggagagtttgatcctggctcaggatgaacgctggcggcatgcctaatacatgcaagtcgaacgaagtttcgaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgcccatcaaggcgtgaacatggatggacctgcggc gcattagctagttggtgaggtaacggcccaccaaggcgatgatgcgtagccggcctgagagggtaaacggccacattggga ctgagacacggcccaaactcctacgggaggcagcagtagggaattttcgtcaatggggggaaccctgaacgagcaatgccg cgtgagtgaagaaggtcttcggatcgtaaagctctgttgtaagtgaagaacggatcatagaggaaatgctatgggagtgacgg tagcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcctggggagtatgcacgcaagtgtgaa actcaaaggaattgacgggggcccgcacaagcggtggagtatgtggtttaattcgaagcaacgcgaagaaccttaccaggcc ttgacatggaaacaaataccctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcgg ccacaaagagcagcgacacagtgatgtgaagcgaatctcataaaggtcgtctcagttcggattgaagtctgcaactcgacttca tgaagtcggaatcgctagtaatcgcagatcagcatgctgcggtgaatacgttctcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctccttt |

TABLE 5-continued

| Full length 16S rDNA sequences of species (negative correlates) | | |
|---|---|---|
| Species Name | Sequence Identifier | 16S rDNA sequence |
| *Erysipelotrichaceae_bacterium_6_1_45* | SEQ ID NO: 163 | atggagagtttgatcctggctcaggatgaacgctggcggcatgcctaatacatgcaagtcgaacgaagtttcgaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgcccatcaaggcgtgaacatggatggacctgcggc gcattagctagttggtgaggtaacggcccaccaaggcgatgatgcgtagccggcctgagagggtaaacggccacattggga ctgagacacggcccaaactcctacgggaggcagcagtagggaattttcgtcaatggggg aaaccctgaacgagcaatgccg cgtgagtgaagaaggtcttcggatcgtaaagctctgttgtaagtgaagaacggatcatagaggaaatgctatgggagtgacgg tagcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcctggggagtatgcacgcaagtgtgaa actcaaaggaattgacgggggcccgcacaagcggtggagtatgtggtttaattcgaagcaacgcgaagaaccttaccaggcc ttgacatggaaacaaataccctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcgg ccacaaagagcagcgacacagtgatgtgaagcgaatctcataaaggtcgtctcagttcggattgaagtctgcaactcgacttca tgaagtcggaatcgctagtaatcgcagatcagcatgctgcggtgaatacgttctcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctccttt |
| *Erysipelotrichaceae_bacterium_21_3* | SEQ ID NO: 164 | atggagagtttgatcctggctcaggatgaacgctggcggcatgcctaatacatgcaagtcgaacgaagtttcgaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgcccatcaaggcgtgaacatggatggacctgcggc gcattagctagttggtgaggtaacggcccaccaaggcgatgatgcgtagccggcctgagagggtaaacggccacattggga ctgagacacggcccaaactcctacgggaggcagcagtagggaattttcgtcaatgggggaaaccctgaacgagcaatgccg cgtgagtgaagaaggtcttcggatcgtaaagctctgttgtaagtgaagaacggctcatagaggaaatgctatgggagtgacgg tagcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcctggggagtatgcacgcaagtgtgaa actcaaaggaattgacgggggcccgcacaagcggtggagtatgtggtttaattcgaagcaacgcgaagaaccttaccaggcc ttgacatggatgcaaatgttctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcgg ccacaaagagcagcgacacagtgatgtgaagcgaatctcataaaggtcgtctcagttcggattgaagtctgcaactcgacttca tgaagtcggaatcgctagtaatcgcagatcagcatgctgcggtgaatacgttctcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctccttt |
| *Erysipelotrichaceae_bacterium_21_3* | SEQ ID NO: 165 | atggagagtttgatcctggctcaggatgaacgctggcggcatgcctaatacatgcaagtcgaacgaagtttcgaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgcccatcaaggcgtgaacatggatggacctgcggc gcattagctagttggtgaggtaacggcccaccaaggcgatgatgcgtagccggcctgagagggtaaacggccacattggga ctgagacacggcccaaactcctacgggaggcagcagtagggaattttcgtcaatgggggaaaccctgaacgagcaatgccg cgtgagtgaagaaggtcttcggatcgtaaagctctgttgtaagtgaagaacggctcatagaggaaatgctatgggagtgacgg tagcttaccagaaagccacggctaactacgtgccagcagccgcggtaatacgtaggtggcaagcgttatccggaatcattggg |

TABLE 5-continued

| Full length 16S rDNA sequences of species (negative correlates) | | |
|---|---|---|
| Species Name | Sequence Identifier | 16S rDNA sequence |
| | | cgtaaagggtgcgtaggtggcgtactaagtctgtagtaaaaggcaatggctcaaccattgtaagctatggaaactggtatgctg<br>gagtgcagaagagggcgatggaattccatgtgtagcggtaaaatgcgtagatatatggaggaacaccagtggcgaaggcgg<br>tcgcctggtctgtaactgacactgaggcacgaaagcgtggggagcaaataggattagataccctagtagtccacgccgtaaac<br>gatgagaactaagtgttggaggaattcagtgctgcagttaacgcaataagttctccgcctggggagtatgcacgcaagtgtgaa<br>actcaaaggaattgacgggggcccgcacaagcggtggagtatgtggtttaattcgaagcaacgcgaagaaccttaccaggcc<br>ttgacat |
| *Erysipelotric haceae_bact erium_21_3* | SEQ ID NO: 166 | atggagagtttgatcctggctcaggatgaacgctggcggcatgcctaatacatgcaagtcgaacgaagtttcgaggaagcttg<br>cttccaaagagacttagtggcgaacgggtgagtaacacgtaggtaacctgcccatgtgtccgggataactgctggaaacggta<br>gctaaaaccggataggtatacagagcgcatgctcagtatattaaagcgcccatcaaggcgtgaacatggatggacctgcggc<br>gcattagctagttggtgaggtaacggcccaccaaggcgatgatgcgtagccggcctgagagggtaaacggccacattggga<br>ctgagacacggcccaaactcctacgggaggcagcagtagggaattttcgtcaatgggggaaaccctgaacgagcaatgccg<br>cgtgagtgaagaaggtcttcggatcgtaaagctctgttgtaagtgaagaacggctcatagaggaaatgctatgggagtgacgg<br>tagcttaccagaaagccacggctaactacgtgccagcagccgcggtaatacgtaggtggcaagcgttatccggaatcattggg<br>cgtaaagggtgcgtaggtggcgtactaagtctgtagtaaaaggcaatggctcaaccattgtaagctatggaaactggtatgctg<br>gagtgcagaagagggcgatggaattccatgtgtagcggtaaaatgcgtagatatatggaggaacaccagtggcgaaggcgg<br>tcgcctggtctgtaactgacactgaggcacgaaagcgtggggagcaaataggattagataccctagtagtccacgccgtaaac<br>gatgagaactaagtgttggaggaattcagtgctgcagttaacgcaataagttctccgcctggggagtatgcacgcaagtgtgaa<br>actcaaaggaattgacgggggcccgcacaagcggtggagtatgtggtttaattcgaagcaacgcgaagaaccttaccaggcc<br>ttgacatggatgcaaatgttctagagataggggataattatggatcacacaggtggtgcatggttgtcgtcagctcgtgtcgtg<br>agatgttgggttaagtcccgcaacgagcgcaacccttgtcgcatgttaccagcatcaagttggggactcatgcgagactgccg<br>gtgacaaaccggaggaaggtggggatgacgtcaaatcatcatgccccttatggcctgggctacacacgtactacaatggcgg<br>ccacaaagagcagcgacacagtgatgtgaagcgaatctcataaaggtcgtctcagttcggattgaagtctgcaactcgacttca<br>tgaagtcggaatcgctagtaatcgcagatcagcatgctgcggtgaatacgttctcgggccttgtacacaccgcccgtcaaacca<br>tgggagtcagtaatacccgaagccggtggcataaccgtaaggagtgagccgtcgaaggtaggaccgatgactggggttaag<br>tcgtaacaaggtatccctacgggaacgtggggatggatcacctccttt |
| *Erysipelotric haceae_bact erium_21_3* | SEQ ID NO: 167 | atggagagtttgatcctggctcaggatgaacgctggcggcatgcctaatacatgcaagtcgaacgaagtttcgaggaagcttg<br>cttccaaagagacttagtggcgaacgggtgagtaacacgtaggtaacctgcccatgtgtccgggataactgctggaaacggta<br>gctaaaaccggataggtatacagagcgcatgctcagtatattaaagcgcccatcaaggcgtgaacatggatggacctgcggc<br>gcattagctagttggtgaggtaacggcccaccaaggcgatgatgcgtagccggcctgagagggtaaacggccacattggga<br>ctgagacacggcccaaactcctacgggaggcagcagtagggaattttcgtcaatgggggaaaccctgaacgagcaatgccg<br>cgtgagtgaagaaggtcttcggatcgtaaagctctgttgtaagtgaagaacggctcatagaggaaatgctatgggagtgacgg<br>tagcttaccagaaagccacggctaactacgtgccagcagccgcggtaatacgtaggtggcaagcgttatccggaatcattggg<br>cgtaaagggtgcgtaggtggcgtactaagtctgtagtaaaaggcaatggctcaaccattgtaagctatggaaactggtatgctg<br>gagtgcagaagagggcgatggaattccatgtgtagcggtaaaatgcgtagatatatggaggaacaccagtggcgaaggcgg<br>tcgcctggtctgtaactgacactgaggcacgaaagcgtggggagcaaataggattagataccctagtagtccacgccgtaaac<br>gatgagaactaagtgttggaggaattcagtgctgcagttaacgcaataagttctccgcctggggagtatgcacgcaagtgtgaa<br>actcaaaggaattgacgggggcccgcacaagcggtggagtatgtggtttaattcgaagcaacgcgaagaaccttaccaggcc<br>ttgacatggatgcaaatgttctagagataggggataattatggatcacacaggtggtgcatggttgtcgtcagctcgtgtcgtg<br>agatgttgggttaagtcccgcaacgagcgcaacccttgtcgcatgttaccagcatcaagttggggactcatgcgagactgccg<br>gtgacaaaccggaggaaggtggggatgacgtcaaatcatcatgccccttatggcctgggctacacacgtactacaatggcgg<br>ccacaaagagcagcgacacagtgatgtgaagcgaatctcataaaggtcgtctcagttcggattgaagtctgcaactcgacttca<br>tgaagtcggaatcgctagtaatcgcagatcagcatgctgcggtgaatacgttctcgggccttgtacacaccgcccgtcaaacca<br>tgggagtcagtaatacccgaagccggtggcataaccgtaaggagtgagccgtcgaaggtaggaccgatgactggggttaag<br>tcgtaacaaggtatccctacgggaacgtggggatggatcacctccttt |

TABLE 5-continued

| Full length 16S rDNA sequences of species (negative correlates) | | |
|---|---|---|
| Species Name | Sequence Identifier | 16S rDNA sequence |
| *Erysipelotric haceae_bact erium_21_3* | SEQ ID NO: 168 | atggagagtttgatcctggctcaggatgaacgctggcggcatgcctaatacatgcaagtcgaacgaagtttcgaggaagcttg<br>cttccaaagagacttagtggcgaacgggtgagtaacacgtaggtaacctgcccatgtgtccgggataactgctggaaacggta<br>gctaaaaccggataggtatacagagcgcatgctcagtatattaaagcgcccatcaaggcgtgaacatggatggacctgcggc<br>gcattagctagttggtgaggtaacggcccaccaaggcgatgatgcgtagccggcctgagagggtaaacggccacattggga<br>ctgagacacggcccaaactcctacgggaggcagcagtagggaattttcgtcaatgggggaaaccctgaacgagcaatgccg<br>cgtgagtgaagaaggtcttcggatcgtaaagctctgttgtaagtgaagaacggctcatagaggaaatgctatgggagtgacgg<br>tagcttaccagaaagccacggctaactacgtgccagcagccgcggtaatacgtaggtggcaagcgttatccggaatcattggg<br>cgtaaagggtgcgtaggtggcgtactaagtctgtagtaaaaggcaatggctcaaccattgtaagctatggaaactggtatgctg<br>gagtgcagaagagggcgatggaattccatgtgtagcggtaaaatgcgtagatatatggaggaacaccagtggcgaaggcgg<br>tcgcctggtctgtaactgacactgaggcacgaaagcgtggggagcaaataggattagataccctagtagtccacgccgtaaac<br>gatgagaactaagtgttggaggaattcagtgctgcagttaacgcaataagttctccgcctggggagtatgcacgcaagtgtgaa<br>actcaaaggaattgacgggggcccgcacaagcggtggagtatgtggtttaattcgaagcaacgcgaagaaccttaccaggcc<br>ttgacatggatgcaaatgttctagagatagggggataattatggatcacacaggtggtgcatggttgtcgtcagacgtgtcgtg<br>agatgttgggttaagtcccgcaacgagcgcaacccttgtcgcatgttaccagcatcaagttggggactcatgcgagactgccg<br>gtgacaaaccggaggaaggtggggatgacgtcaaatcatcatgccccttatggcctgggctacacacgtactacaatggcgg<br>ccacaaagagcagcgacacagtgatgtgaagcgaatctcataaaggtcgtctcagttcggattgaagtctgcaactcgacttca<br>tgaagtcggaatcgctagtaatcgcagatcagcatgctgcggtgaatacgttctcgggccttgtacacaccgcccgtcaaacca<br>tgggagtcagtaatacccgaagccggtggcataaccgtaaggagtgagccgtcgaaggtaggaccgatgactggggttaag<br>tcgtaacaaggtatccctacgggaacgtggggatggatcacctccttt |
| *Haemophilu s_parainflue nzae* | SEQ ID NO: 169 | ttgaagagtttgatcatggctcagattgaacgctggcggcaggcttaacacatgcaagtcgaacggtaacataaagaagcttgc<br>ttctttgatgacgagtguggacgggtgagtaatgcttgggaatctagcttatggagggggataactacgggaaactgtagcta<br>ataccgcgtagaatcgggagatgaaagtgtgggaccttcgggccacatgccataggatgagcccaagtgggattaggtagtt<br>ggtgaggtaaaggctcaccaagccgacgatctctagctggtctgagaggatgaccagccacactgggactgagacacggcc<br>cagactcctacgggaggcagcagtggggaatattgcgcaatgggggcaaccctgacgcagccatgccgcgtgaatgaaga<br>aggccttcgggttgtaaagttctttcggtagcgaggaaggcatttagtttaataaactggatgattgacgttaactacagaagaag<br>caccggctaactccgtgccagcagccgcggtaatacggagggtgcgagcgttaatcggaataactgggcgtaaagggcacg<br>caggcggtgacttaagtgaggtgtgaaagccccgggcttaacctgggaattgcatttcatactgggtcgctagagtactttagg<br>gaggggtagaattccacgtgtagcggtgaaatgcgtagagatgtggaggaataccgaaggcgaaggcagccccttgggaat<br>gtactgacgctcatgtgcgaaagcgtggggagcaaacaggattagataccctggtagtccacgctgtaaacgatgtcgatttg<br>gggggttgagctttaagtttggcgcccgtagctaacgtgataaatcgaccgcctggggagtacggccgcaaggttaaaactcaa<br>atgaattgacgggggcccgcacaagcggtggagcatgtggtttaattcgatgcaacgcgaagaaccttacctactcttgacatc<br>cagagaacattccagagatggattggtgccttcgggaactctgagacaggtgctgcatggctgtcgtcagctcgtgttgtgaaa<br>tgttgggttaagtcccgcaacgagcgcaacccttatcctttgagccagcgatttggtcgggaactcaaaggagactgccggtg<br>ataaaccggaggaaggtggggatgacgtcaagtcatcatggcccttacgagtagggctacacacgtgctacaatggcgtata<br>cagagggaagcgagagtgcgagctggagcgaatctcacaaagtacgtctaagtccggattggagtctgcaactcgactccat<br>gaagtcggaatcgctagtaatcgcaaatcagaatgttgcggtgaatacgttcccgggccttgtacacaccgcccgtcacaccat<br>gggagtgggttgtaccagaagtagatagcttaaccacgggggggcgtttaccacggtatgattcatgactggggtgaagtcgt<br>aacaaggtaaccgtaggggaacctgcggttggatcacctcctt |
| *Streptococc us_parasang uinis* | SEQ ID NO: 170 | taatgagagtttgatcctggctcaggatgaacgctggcggcgtgcctaatacatgcaagtagaacgctgaagcttggtgcttgc<br>accgagcggaggagttgcgaacgggtgagtaacgcgtaggtaacctgcctcttagcgggggataactattggaaacgatagc<br>taataccgcataaaagtcgacattgcatgatgttgacttgaaaggtgcaactgcatcactaagagatggacctgcgttgtattagc<br>tagttggtgaggtaacggctcaccaaggcgacgatacatagccgacctgagagggtgatcggccacactgggactgagaca<br>cggcccagactcctacgggaggcagcagtagggaatcttcggcaatggacggaagtctgaccgagcaacgccgcgtgagt<br>gaagaaggttttcggatcgtaaagctctgagtaagagaagaacgagtgtgagagtggaaagttcacactgtgacggtaactta<br>ccagaaagggacggctaactacgtgccagcagccgcggtaatacgtaggtcccgagcgttatccggatttattgggcgtaaa |

TABLE 5-continued

Full length 16S rDNA sequences of species (negative correlates)

| Species Name | Sequence Identifier | 16S rDNA sequence |
|---|---|---|
| | | gcgagcgcaggcggttagataagtctgaagttaaaggctgtggcttaaccatagtacgctttggaaactgtttaacttgagtgca gaaggggagagtggaattccatgtgtagcggtgaaatgcgtagatatatggaggaacaccggtggcgaaagcggctctctgg tctgtaactgacgctgaggctcgaaagcgtggggagcaaacaggattagataccctggtagtccacgccgtaaacgatgagt gctaggtgttgggtcctttccgggactcagtgccgcagctaacgcattaagcactccgcctggggagtacgaccgcaaggttg aaactcaaaggaattgacgggggcccgcacaagcggtggagcatgtggtttaattcgaagcaacgcgaagaaccttaccag gtcttgacatccctctgaccgctctagagatagagctttccttcgggacagaggtgacaggtggtgcatggttgtcgtcagctcg tgtcgtgagatgttgggttaagtcccgcaacgagcgcaacccctattgttagttgccatcatttagagggcactctagcgagact gccggtaataaaccggaggaaggtggggatgacgtcaaatcatcatgccccttatgacctgggctacacacgtgctacaatgg ctggtacaacgagtcgcgagtcggtgacggcaagctaatctcttaaagccagtctcagttcggattgtaggctgcaactcgcct acatgaagtcggaatcgctagtaatcgcggatcagcacgccgcggtgaatacgttcccgggccttgtacacaccgcccgtcac accacgagagtttgtaacacccgaagtcggtgaggtaaccttttaggagccagccgcctaaggtgggatagatgattggggtg aagtcgtaacaaggtagccgtatcggaaggtgcggctggatcacctccttt |
| *Streptococcus_parasanguinis* | SEQ ID NO: 171 | taatgagagtttgatcctggctcaggatgaacgctggcggcgtgcctaatacatgcaagtagaacgctgaagcttggtgcttgc accgagcggaggagttgcgaacgggtgagtaacgcgtaggtaacctgcctcttagcgggggataactattggaaacgatagc taataccgcataaaagtcgacattgcatgatgttgacttgaaaggtgcaaatgcatcactgagagatggacctgcgttgtattagc tagttggtgaggtaacggctcaccaaggcgacgatacatagccgacctgagagggtgatcggccacactgggactgagaca cggcccagactcctacgggaggcagcagtagggaatcttcggcaatggacggaagtctgaccgagcaacgccgcgtgagt gaagaaggttttcggatcgtaaagctctgttgtaagagaagaacgagtgtgagagtggaaagttcacactgtgacggtaactta ccagaaagggacggctaactacgtgccagcagccgcggtaatacgtaggtcccgagcgttatccggatttattgggcgtaaa gcgagcgcaggcggttagataagtctgaagttaaaggctgtggcttaaccatagtacgctttggaaactgtttaacttgagtgca gaaggggagagtggaattccatgtgtagcggtgaaatgcgtagatatatggaggaacaccggtggcgaaagcggctctctgg tctgtaactgacgctgaggctcgaaagcgtggggagcaaacaggattagataccctggtagtccacgccgtaaacgatgagt gctaggtgttggtcctttccgggactcagtgccgcagctaacgcattaagcactccgcctggggagtacgaccgcaaggttga aactcaaaggaattgacgggggcccgcacaagcggtggagcatgtggtttaattcgaagcaacgcgaagaaccttaccaggt cttgacatccctctgaccgctctagagatagagctttccttcgggacagaggtgacaggtggtgcatggttgtcgtcagctcgtg tcgtgagatgttgggttaagtcccgcaacgagcgcaacccctattgttagttgccatcatttagttgggcactctagcgagactgc cggtaataaaccggaggaaggtggggatgacgtcaaatcatcatgccccttatgacctgggctacacacgtgctacaatggct ggtacaacgagtcgcgagtcggtgacggcaagctaatctcttaaagccagtctcagttcggattgtaggctgcaactcgcctac atgaagtcggaatcgctagtaatcgcggatcagcacgccgcggtgaatacgttcccgggccttgtacacaccgcccgtcacac cacgagagtttgtaacacccgaagtcggtgaggtaaccttttaggagccagccgcctaaggtgggatagatgattggggtgaa gtcgtaacaaggtagccgtatcggaaggtgcggctggatcacctccttt |
| *Streptococcus_parasanguinis* | SEQ ID NO: 172 | taatgagagtttgatcctggctcaggatgaacgctggcggcgtgcctaatacatgcaagtagaacgctgaagcttggtgcttgc accgagcggaggagttgcgaacgggtgagtaacgcgtaggtaacctgcctcttagcgggggataactattggaaacgatagc taataccgcataaaagtcgacattgcatgatgttgacttgaaaggtgcaactgcatcactaagagatggacctgcgttgtattagc tagttggtgaggtaacggctcaccaaggcgacgatacatagccgacctgagagggtgatcggccacactgggactgagaca cggcccagactcctacgggaggcagcagtagggaatcttcggcaatggacggaagtctgaccgagcaacgccgcgtgagt gaagaaggttttcggatcgtaaagctctgttgtaagagaagaacgagtgtgagagtggaaagttcacactgtgacggtaactta ccagaaagggacggctaactacgtgccagcagccgcggtaatacgtaggtcccgagcgttatccggatttattgggcgtaaa gcgagcgcaggcggttagataagtctgaagttaaaggctgtggcttaaccatagtacgctttggaaactgtttaacttgagtgca gaaggggagagtggaattccatgtgtagcggtgaaatgcgtagatatatggaggaacaccggtggcgaaagcggctctctgg tctgtaactgacgctgaggctcgaaagcgtggggagcaaacaggattagataccctggtagtccacgccgtaaacgatgagt gctaggtgttgggtcctttccgggactcagtgccgcagctaacgcattaagcactccgcctggggagtacgaccgcaaggttg aaactcaaaggaattgacgggggcccgcacaagcggtggagcatgtggtttaattcgaagcaacgcgaagaaccttaccag gtcttgacatccctctgaccgctctagagatagagctttccttcgggacagaggtgacaggtggtgcatggttgtcgtcagctcg tgtcgtgagatgttgggttaagtcccgcaacgagcgcaacccctattgttagttgccatcatttagttgggcactctagcgagact gccggtaataaaccggaggaaggtggggatgacgtcaaatcatcatgccccttatgacctgggctacacacgtgctacaatgg |

TABLE 5-continued

Full length 16S rDNA sequences of species (negative correlates)

| Species Name | Sequence Identifier | 16S rDNA sequence |
|---|---|---|
| | | ctggtacaacgagtcgcgagtcggtgacggcaagctaatctcttaaagccagtctcagttcggattgtaggctgcaactcgcct<br>acatgaagtcggaatcgctagtaatcgcggatcagcacgccgcggtgaatacgttcccgggccttgtacacaccgcccgtcac<br>accacgagagtttgtaacacccgaagtcggtgaggtaacctttaggagccagccgcctaaggtgggatagatgattggggtg<br>aagtcgtaacaaggtagccgtatcggaaggtgcggctggatcacctccttt |
| *Streptococcus_parasanguinis* | SEQ ID NO: 173 | aatgagagtttgatcctggctcaggatgaacgctggcggcgtgcctaatacatgcaagtagaacgctgaagcttggtgcttgca<br>ccgagcggatgagttgcgaacgggtgagtaacgcgtaggtaacctacctcttagcgggggataactattggaaacgatagcta<br>ataccgcataaaagtcggcattgcatgatgagacttgaaaggtgcaaatgcatcactgagagatggacctgcgttgtattagct<br>agttggtgaggtaacggctcaccaaggcgacgatacatagccgacctgagagggtgatcggccacactgggactgagacac<br>ggcccagactcctacgggaggcagcagtagggaatcttcggcaatggacggaagtctgaccgagcaacgccgcgtgagtg<br>aagaaggttttcggatcgtaaagctctgttgtaagagaagaacgagtgtgagagtggaaagttcacactgtgacggtaacttac<br>cagaaagggacggctaactacgtgccagcagccgcggtaatacgtaggtcccgagcgttatccggatttattgggcgtaaag<br>cgagcgcaggcggttagataagtctgaagttaaaggctgtggcttaaccatagtacgctttggaaactgtttaacttgagtgcag<br>aaggggagagtggaattccatgtgtagcggtgaaatgcgtagatatatggaggaacaccggtggcgaaagcggctctctggt<br>ctgtaactgacgctgaggctcgaaagcgtggggagcaaacaggattagataccctggtagtccacgccgtaaacgatgagtg<br>ctaggtgttgggtcctttccgggactcagtgccgcagctaacgcattaagcactccgcctggggagtacgaccgcaaggttga<br>aactcaaaggaattgacgggggcccgcacaagcggtggagcatgtggtttaattcgaagcaacgcgaagaaccttaccaggt<br>cttgacatccctctgaccgctctagagatagagctttccttcgggacagaggtgacaggtggtgcatggttgtcgtcagctcgtg<br>tcgtgagatgttgggttaagtcccgcaacgagcgcaacccctattgttagttgccatcatttagttgggcactctagcgagactgc<br>cggtaataaaccggaggaaggtggggatgacgtcaaatcatcatgccccttatgacctgggctacacacgtgctacaatggct<br>ggtacaacgagtcgcgagtcggtgacggcaagctaatctcttaaagccagtctcagttcggattgtaggctgcaactcgcctac<br>atgaagtcggaatcgctagtaatcgcggatcagcacgccgcggtgaatacgttcccgggccttgtacacaccgcccgtcacac<br>cacgagagtttgtaacacccgaagtcggtgaggtaacctttaggagccagccgcctaaggtgggatagatgattggggtgaa<br>gtcgtaacaaggtagccgtatcggaaggtgcggctggatcacctcctt |
| *Bacteroides_dorei* | SEQ ID NO: 174 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>gggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatgggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |

TABLE 5-continued

Full length 16S rDNA sequences of species (negative correlates)

| Species Name | Sequence Identifier | 16S rDNA sequence |
|---|---|---|
| *Bacteroides _dorei* | SEQ ID NO: 175 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggg ttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatgggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 176 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggg ttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggagtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgecgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatgggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 177 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggg ttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg |

TABLE 5-continued

| Full length 16S rDNA sequences of species (negative correlates) | | |
|---|---|---|
| Species Name | Sequence Identifier | 16S rDNA sequence |
| | | gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 178 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattaccggtagacgatggggatgcgttccattagat<br>agtaggcggggtaacggcccacctagtcaacgatggatagggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 179 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatggggggtacagagggcc |

TABLE 5-continued

| Full length 16S rDNA sequences of species (negative correlates) | | |
|---|---|---|
| Species Name | Sequence Identifier | 16S rDNA sequence |
| | | gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 180 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattaccggtagacgatggggatgcgttccattagat<br>agtaggcggggtaacggcccacctagtcaacgatggatagggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgctttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatgggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 181 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggatagggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatgggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |

TABLE 5-continued

| Full length 16S rDNA sequences of species (negative correlates) | | |
|---|---|---|
| Species Name | Sequence Identifier | 16S rDNA sequence |
| *Bacteroides _dorei* | SEQ ID NO: 182 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggataggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _dorei* | SEQ ID NO: 183 | atgaagagtttgatcctggctcaggatgaacgctagctacaggcttaacacatgcaagtcgaggggcagcatggtcttagcttg<br>ctaaggctgatggcgaccggcgcacgggtgagtaacacgtatccaacctgccgtctactcttggccagccttctgaaaggaag<br>attaatccaggatgggatcatgagttcacatgtccgcatgattaaaggtattttccggtagacgatggggatgcgttccattagat<br>agtaggcggggtaacggcccacctagtcaacgatggataggggttctgagaggaaggtcccccacattggaactgagacac<br>ggtccaaactcctacgggaggcagcagtgaggaatattggtcaatgggcgatggcctgaaccagccaagtagcgtgaagga<br>tgactgccctatgggttgtaaacttcttttataaaggaataaagtcgggtatgcatacccgtttgcatgtactttatgaataaggatc<br>ggctaactccgtgccagcagccgcggtaatacggaggatccgagcgttatccggatttattgggtttaaagggagcgtagatg<br>gatgtttaagtcagttgtgaaagtttgcggctcaaccgtaaaattgcagttgatactggatgtcttgagtgcagttgaggcaggcg<br>gaattcgtggtgtagcggtgaaatgcttagatatcacgaagaactccgattgcgaaggcagcctgctaagctgcaactgacatt<br>gaggctcgaaagtgtgggtatcaaacaggattagataccctggtagtccacacggtaaacgatgaatactcgctgtttgcgatat<br>acggcaagcggccaagcgaaagcgttaagtattccacctggggagtacgccggcaacggtgaaactcaaaggaattgacg<br>ggggcccgcacaagcggaggaacatgtggtttaattcgatgatacgcgaggaaccttacccgggcttaaattgcactcgaatg<br>atccggaaacggttcagctagcaatagcgagtgtgaaggtgctgcatggttgtcgtcagctcgtgccgtgaggtgtcggcttaa<br>gtgccataacgagcgcaacccttgttgtcagttactaacaggtgatgctgaggactctgacaagactgccatcgtaagatgtga<br>ggaaggtggggatgacgtcaaatcagcacggcccttacgtccggggctacacacgtgttacaatggggggtacagagggcc<br>gctaccacgcgagtggatgccaatccctaaaacccctctcagttcggactggagtctgcaacccgactccacgaagctggatt<br>cgctagtaatcgcgcatcagccacggcgcggtgaatacgttcccgggccttgtacacaccgcccgtcaagccatgggagccg<br>ggggtacctgaagtgcgtaaccgcgaggatcgccctagggtaaaactggtgactggggctaagtcgtaacaaggtagccgta<br>ccggaaggtgcggctggaacacctcctt |
| *Bacteroides _fragilis* | SEQ ID NO: 184 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatagcataatgattccgcatggtttcattattaaaggattccggtaaaggatggggatgcgttccattaggttgttg<br>gtgaggtaacggctcaccaagccttcgatggataggggttctgagaggaaggtcccccacattggaactgagacacggtcca<br>aactcctacgggaggcagcagtgaggaatattggtcaatgggcgttagcctgaaccagccaagtagcgtgaaggatgaagg<br>ctctatgggtcgtaaacttcttttatataagaataaagtgcagtatgtatactgttttgtatgtattatatgaataaggatcggctaactc<br>cgtgccagcagccgcggtaatacggaggatccgagcgttatccggatttattgggtttaaagggagcgtaggtggactggtaa |

TABLE 5-continued

Full length 16S rDNA sequences of species (negative correlates)

| Species Name | Sequence Identifier | 16S rDNA sequence |
|---|---|---|
| | | gtcagttgtgaaagtttgcggctcaaccgtaaaattgcagttgatactgtcagtcttgagtacagtagaggtgggcggaattcgtg<br>gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatcttcagttactaacaggtcatgctgaggactctggagagactgccgtcgtaagatgtgaggaaggtg<br>gggatgacgtcaaatcagcacggcccttacgtccggggctacacacgtgttacaatgggggtacagaaggcagctagcgg<br>gtgaccgtatgctaatcccaaaagcctctctcagttcggatcgaagtctgcaacccgacttcgtgaagctggattcgctagtaat<br>cgcgcatcagccacggcgcggtgaatacgttcccgggccttgtacacaccgcccgtcaagccatgggagccgggggtacct<br>gaagtacgtaaccgcaaggatcgtcctagggtaaaactggtgactggggctaagtcgtaacaaggtagccgtaccggaaggt<br>gcggctggaacacctcctt |
| *Bacteroides _fragilis* | SEQ ID NO: 185 | aaaggatggggatgcgttccattaggttgttggtgaggtaacggctcaccaagccttcgatggataggggttctgagaggaag<br>gtcccccacattggaactgagacacggtccaaactcctacgggaggcagcagtgaggaatattggtcaatgggcgctagcct<br>gaaccagccaagtagcgtgaaggatgaaggctctatgggtcgtaaacttcttttatataagaataaagtgcagtatgtatactgttt<br>tgtatgtattatatgaataaggatcggctaactccgtgccagcagccgcggtaatacggaggatccgagcgttatccggatttatt<br>gggtttaaagggagcgtaggtggactggtaagtcagttgtgaaagtttgcggctcaaccgtaaaattgcagttgatactgtcagt<br>cttgagtacagtagaggtgggcggaattcgtggtgtagcggtgaaatgcttagatatcacgaagaactccgattgcgaaggca<br>gctcactggactgcaactgacactgatgctcgaaagtgtgggtatcaaacaggattagataccctggtagtccacacagtaaac<br>gatgaatactcgctgtttgcgatatacagtaagcggccaagcgaaagcattaagtattccacctggggagtacgccggcaacg<br>gtgaaactcaaaggaattgacgggggcccgcacaagcggaggaacatgtggtttaattcgatgatacgcgaggaaccttacc<br>cgggcttaaattgcagtggaatgatgtggaaacatgtcagtgagcaatcaccgctgtgaaggtgctgcatggttgtcgtcagct<br>cgtgccgtgaggtgtcggcttaagtgccataacgagcgcaacccttatcttcagttactaacaggttatgctgaggactctggag<br>agactgccgtcgtaagatgtgaggaaggtggggatgacgtcaaatcagcacggcccttacgtccggggctacacacgtgtta<br>caatgggggtacagaaggcagctagcgggtgaccgtatgctaatcccaaaagcctctctcagttcggatcgaagtctgcaac<br>ccgacttcgtgaagctggattcgctagtaatcgcgcatcagccacggcgcggtgaatacgttcccgggccttgtacacaccgc<br>ccgtcaagccatgggagccgggggtacctgaagtacgtaaccgcaaggatcgtcctagggtaaaactggtgactggggcta<br>agtcgtaacaaggtagccgtaccggaaggtgcggctggaacacctcctt |
| *Bacteroides _fragilis* | SEQ ID NO: 186 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatagtataatgattccgcatggtttcattattaaaggattccggtaaaggatggggatgcgttccattaggttgttg<br>gtgaggtaacggcccaccaagccttcgatggataggggttctgagaggaaggtcccccacattggaactgagacacggtcca<br>aactcctacgggaggcagcagtgaggaatattggtcaatgggcgttagcctgaaccagccaagtagcgtgaaggatgaagg<br>ctctatgggtcgtaaacttcttttatataagaataaagtgcagtatgttttactgttttgtatgtattatatgaataaggatcggctaactc<br>cgtgccagcagccgcggtaatacggaggatccgagcgttatccggatttattgggtttaaagggagcgtaggtggactggtaa<br>gtcagttgtgaaagtttgcggctcaaccgtaaaattgcagttgatactgtcagtcttgagtacagtagaggtgggcggaattcgtg<br>gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatcttcagttactaacaggtcatgctgaggactctggagagactgccgtcgtaagatgtgaggaaggtg<br>gggatgacgtcaaatcagcacggcccttacgtccggggctacacacgtgttacaatgggggtacagaaggcagctagcgg<br>gtgaccgtatgctaatcccaaaagcctctctcagttcggatcgaagtctgcaacccgacttcgtgaagctggattcgctagtaat<br>cgcgcatcagccacggcgcggtgaatacgttcccgggccttgtacacaccgcccgtcaagccatgggagccgggggtacct |

TABLE 5-continued

Full length 16S rDNA sequences of species (negative correlates)

| Species Name | Sequence Identifier | 16S rDNA sequence |
|---|---|---|
| | | gaagtacgtaaccgcaaggatcgtcctagggtaaaactggtgactggggctaagtcgtaacaaggtagccgtaccggaaggt<br>gcggctggaacacctcctt |
| *Bacteroides _fragilis* | SEQ ID NO: 187 | gcatggtttcattattaaaggattccggtaaaggatggggatgcgttccattaggttgttggtgaggtaacggctcaccaagcctt<br>cgatggataggggttctgagaggaaggtcccccacattggaactgagacacggtccaaactcctacgggaggcagcagtga<br>ggaatattggtcaatgggcgctagcctgaaccagccaagtagcgtgaaggatgaaggctctatgggtcgtaaacttcttttatat<br>aagaataaagtgcagtatgtatactgttttgtatgtattatatgaataaggatcggctaactccgtgccagcagccgcggtaatac<br>ggaggatccgagcgttatccggatttattgggtttaaagggagcgtaggtggactggtaagtcagttgtgaaagtttgcggctca<br>accgtaaaattgcagttgatactgtcagtcttgagtacagtagaggtgggcggaattcgtggtgtagcggtgaaatgcttagatat<br>cacgaagaactccgattgcgaaggcagacactggactgcaactgacactgatgctcgaaagtgtgggtatcaaacaggatta<br>gataccctggtagtccacacagtaaacgatgaatactcgctgtttgcgatatacagtaagcggccaagcgaaagcattaagtatt<br>ccacctggggagtacgccggcaacggtgaaactcaaaggaattgacgggggcccgcacaagcggaggaacatgtggttta<br>attcgatgatacgcgaggaaccttacccgggcttaaattgcagtggaatgatgtggaaacatgtcagtgagcaatcaccgctgt<br>gaaggtgctgcatggttgtcgtcagctcgtgccgtgaggtgtcggcttaagtgccataacgagcgcaacccttatctttagttact<br>aacaggttatgctgaggactctggagagactgccgtcgtaagatgtgaggaaggtggggatgacgtcaaatcagcacggccc<br>ttacgtccggggctacacacgtgttacaatggggggtacagaaggcagctagcgggtgaccgtatgctaatcccaaaagcct<br>ctctcagttcggatcgaagtctgcaacccgacttcgtgaagctggattcgctagtaatcgcgcatcagccacggcgcggtgaat<br>acgttcccgggccttgtacacaccgcccgtcaagccatgggagccgggggtacctgaagtacgtaaccgcaaggatcgtcct<br>agggtaaaactggtgactggggctaagtcgtaacaaggtagccgtaccggaaggtgcggctggaacacctcctt |
| *Bacteroides _fragilis* | SEQ ID NO: 188 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatagtataatgattccgcatggtttcattattaaaggattccggtaaaggatggggatgcgttccattaggttgttg<br>gtgaggtaacggctcaccaagccttcgatggataggggttctgagaggaaggtcccccacattggaactgagacacggtcca<br>aactcctacgggaggcagcagtgaggaatattggtcaatgggcgctagcctgaaccagccaagtagcgtgaaggatgaagg<br>ctctatgggtcgtaaacttcttttatataagaataaagtgcagtatgtatactgttttgtatgtattatatgaataaggatcggctaactc<br>cgtgccagcagccgcggtaatacggaggatccgagcgttatccggatttattgggtttaaagggagcgtaggtggactggtaa<br>gtcagttgtgaaagtttgcggctcaaccgtaaaattgcagttgatactgtcagtcttgagtacagtagaggtgggcggaattcgtg<br>gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatctttagttactaacaggttatgctgaggactctggagagactgccgtcgtaagatgtgaggaaggtgg<br>ggatgacgtcaaatcagcacggcccttacgtccggggctacacacgtgttacaatggggggtacagaaggcagctagcggg<br>tgaccgtatgctaatcccaaaagcctctctcagttcggatcgaagtctgcaacccgacttcgtgaagctggattcgctagtaatc<br>gcgcatcagccacggcgcggtgaatacgttcccgggccttgtacacaccgcccgtcaagccatgggagccgggggtacctg<br>aagtacgtaaccgcaaggatcgtcctagggtaaaactggtgactggggctaagtcgtaacaaggtagccgtaccggaaggtg<br>cggctggaacacctcctt |
| *Bacteroides _fragilis* | SEQ ID NO: 189 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatggcataatgattccgcatggtttcattattaaaggattccggtaaaggatggggatgcgttccattaggttgttg<br>gtgaggtaacggcccaccaagccttcgatggataggggttctgagaggaaggtcccccacattggaactgagacacggtcca<br>aactcctacgggaggcagcagtgaggaatattggtcaatgggcgctagcctgaaccagccaagtagcgtgaaggatgaagg<br>ctctatgggtcgtaaacttcttttatataagaataaagtgcagtatgtatactgttttgtatgtattatatgaataaggatcggctaactc<br>cgtgccagcagccgcggtaatacggaggatccgagcgttatccggatttattgggtttaaagggagcgtaggtggactggtaa<br>gtcagttgtgaaagtttgcggctcaaccgtaaaattgcagttgatactgtcagtcttgagtacagtagaggtgggcggaattcgtg |

TABLE 5-continued

Full length 16S rDNA sequences of species (negative correlates)

| Species Name | Sequence Identifier | 16S rDNA sequence |
|---|---|---|
| | | gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatcttcagttactaacaggtcatgctgaggactctggagagactgccgtcgtaagatgtgaggaaggtg<br>gggatgacgtcaaatcagcacggcccttacgtccggggctacacacgtgttacaatgggggtacagaaggcagctagcgg<br>gtgaccgtatgctaatcccaaaagcctctctcagttcggatcgaagtctgcaacccgacttcgtgaagctggattcgctagtaat<br>cgcgcatcagccacggcgcggtgaatacgttcccgggccttgtacacaccgcccgtcaagccatgggagccgggggtacct<br>gaagtacgtaaccgcaaggatcgtcctagggtaaaactggtgactggggctaagtcgtaacaaggtagccgtaccggaaggt<br>gcggctggaacacctcctt |
| *Bacteroides _fragilis* | SEQ ID NO: 190 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatggcataatgattccgcatggtttcattattaaaggattccggtaaaggatggggatgcgttccattaggttgttg<br>gtgaggtaacggctcaccaagccttcgatggatagggg ttctgagaggaaggtcccccacattggaactgagacacggtcca<br>aactcctacgggaggcagcagtgaggaatattggtcaatgggcgctagcctgaaccagccaagtagcgtgaaggatgaagg<br>ctctatgggtcgtaaacttcttttatataagaataaagtgcagtatgtatactgttttgtatgtattatatgaataaggatcggctaactc<br>cgtgccagcagccgcggtaatacggaggatccgagcgttatccggatttattgggtttaaagggagcgtaggtggactggtaa<br>gtcagttgtgaaagtttgcggctcaaccgtaaaattgcagttgatactgtcagtcttgagtacagtagaggtgggcggaattcgtg<br>gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatcttcagttactaacaggtcatgctgaggactctggagagactgccgtcgtaagatgtgaggaaggtg<br>gggatgacgtcaaatcagcacggcccttacgtccggggctacacacgtgttacaatgggggtacagaaggcagctagcgg<br>gtgaccgtatgctaatcccaaaagcctctctcagttcggatcgaagtctgcaacccgacttcgtgaagctggattcgctagtaat<br>cgcgcatcagccacggcgcggtgaatacgttcccgggccttgtacacaccgeccgtcaagccatgggagccgggggtacct<br>gaagtacgtaaccgcaaggatcgtcctagggtaaaactggtgactggggctaagtcgtaacaaggtagccgtaccggaaggt<br>gcggctggaacacctcctt |
| *Bacteroides _fragilis* | SEQ ID NO: 191 | atgaagagtttgatcctggctcaggatgaacgctagctacaggcttaacacatgcaagtcgaggggcatcaggaagaaagctt<br>gctttctttgctggcgaccggcgcacgggtgagtaacacgtatccaacctgccctttactcggggatagcctttcgaaagaaag<br>attaatacccgatggcataatgattccgcatggtttcattattaaaggattccggtaaaggatggggatgcgttccattaggttgttg<br>gtgaggtaacggcccaccaagccttcgatggataggggttctgagaggaaggtcccccacattggaactgagacacggtcca<br>aactcctacgggaggcagcagtgaggaatattggtcaatgggcgctagcctgaaccagccaagtagcgtgaaggatgaagg<br>ctctatgggtcgtaaacttcttttatataagaataaagtgcagtatgtatactgttttgtatgtattatatgaataaggatcggctaactc<br>cgtgccagcagccgcggtaatacggaggatccgagcgttatccggatttattgggtttaaagggagcgtaggtggactggtaa<br>gtcagttgtgaaagtttgcggctcaaccgtaaaattgcagttgatactgtcagtcttgagtacagtagaggtgggcggaattcgtg<br>gtgtagcggtgaaatgcttagatatcacgaagaactccgattgcgaaggcagctcactggactgcaactgacactgatgctcg<br>aaagtgtgggtatcaaacaggattagataccctggtagtccacacagtaaacgatgaatactcgctgtttgcgatatacagtaag<br>cggccaagcgaaagcattaagtattccacctggggagtacgccggcaacggtgaaactcaaaggaattgacgggggcccg<br>cacaagcggaggaacatgtggtttaattcgatgatacgcgaggaaccttacccgggcttaaattgcagtggaatgatgtggaaa<br>catgtcagtgagcaatcaccgctgtgaaggtgctgcatggttgtcgtcagctcgtgccgtgaggtgtcggcttaagtgccataa<br>cgagcgcaacccttatcttcagttactaacaggtcatgctgaggactctggagagactgccgtcgtaagatgtgaggaaggtg<br>gggatgacgtcaaatcagcacggcccttacgtccggggctacacacgtgttacaatgggggtacagaaggcagctagcgg<br>gtgaccgtatgctaatcccaaaagcctctctcagttcggatcgaagtctgcaacccgacttcgtgaagctggattcgctagtaat |

TABLE 5-continued

| Full length 16S rDNA sequences of species (negative correlates) | | |
|---|---|---|
| Species Name | Sequence Identifier | 16S rDNA sequence |
| | | cgcgcatcagccacggcgcggtgaatacgttcccgggccttgtacacaccgcccgtcaagccatgggagccgggggtacct gaagtacgtaaccgcaaggatcgtcctagggtaaaactggtgactggggctaagtcgtaacaaggtagccgtaccggaaggt gcggctggaacacctcctt |
| *Bacteroides _uniformis* | SEQ ID NO: 192 | actgagacacggtccaaactcctacgggaggcagcagtgaggaatattggtcaatggacgagagtctgaaccagccaagta gcgtgaaggatgactgccctatgggttgtaaacttcttttatacgggaataaagtgaggcacgtgtgccttttttgtatgtaccgtat gaataaggatcggctaactccgtgccagcagccgcggtaatacggaggatccgagcgttatccggatttattgggtttaaagg gagcgtaggcggacgcttaagtcagttgtgaaagtttgcggctcaaccgtaaaattgcagttgatactgggtgtcttgagtacag tagaggcaggcggaattcgtggtgtagcggtgaaatgcttagatatcacgaagaactccgattgcgaaggcagcttgctggac tgtaactgacgctgatgctcgaaagtgtgggtatcaaacaggattagataccctggtagtccacacagtaaacgatgaatacte gctgtttgcgatatacagtaagcggccaagcgaaagcgttaagtattccacctggggagtacgccggcaacggtgaaactcaa aggaattgacgggggcccgcacaagcggaggaacatgtggtttaattcgatgatacgcgaggaaccttacccgggcttgaatt gcaactgaatgatgtggagacatgtcagccgcaaggcagttgtgaaggtgctgcatggttgtcgtcagctcgtgccgtgaggt gtcggcttaagtgccataacgagcgcaacccttatcgatagttaccatcaggttatgctggggactctgtcgagactgccgtcgt aagatgtgaggaaggtggggatgacgtcaaatcagcacggcccttacgtccggggctacacacgtgttacaatgggggtac agaaggcagctacacggcgacgtgatgctaatcccgaaagcctctctcagttcggattggagtctgcaacccgactccatgaa gctggattcgctagtaatcgcgcatcagccacggcgcggtgaatacgttcccgggccttgtacacaccgcccgtcaagccatg aaagccgggggtacctgaagtgcgtaaccgcaaggagcgccctagggtaaaactggtgattggggctaagtcgtaacaagg tagccgtaccggaaggtgcggctggaacacctcctt |
| *Bacteroides _uniformis* | SEQ ID NO: 193 | atgaagagtttgatcctggctcaggatgaacgctagctacaggcttaacacatgcaagtcgaggggcagcatgaacttagcttg ctaagtttgatggcgaccggcgcacgggtgagtaacacgtatccaacctgccgatgactcggggatagcctttcgaaagaaa gattaatacccgatggcatagttcttccgcatggtggaactattaaagaatttcggtcatcgatggggatgcgttccattaggttgtt ggcggggtaacggcccaccaagccttcgatggataggggttctgagaggaaggtcccccacattggaactgagacacggtc caaactcctacgggaggcagcagtgaggaatattggtcaatggacgagagtctgaaccagccaagtagcgtgaaggatgact gccctatgggttgtaaacttcttttatacgggaataaagtgaggcacgtgtgccttttttgtatgtaccgtatgaataaggatcggcta actccgtgccagcagccgcggtaatacggaggatccgagcgttatccggatttattgggtttaaagggagcgtaggcggacg cttaagtcagttgtgaaagtttgcggctcaaccgtaaaattgcagttgatactgggtgtcttgagtacagtagaggcaggcggaa ttcgtggtgtagcggtgaaatgcttagatatcacgaagaactccgattgcgaaggcagcttgctggactgtaactgacgctgatg ctcgaaagtgtgggtatcaaacaggattagataccctggtagtccacacagtaaacgatgaatactcgctgtttgcgatatacag taagcggccaagcgaaagcgttaagtattccacctggggagtacgccggcaacggtgaaactcaaaggaattgacgggggc ccgcacaagcggaggaacatgtggtttaattcgatgatacgcgaggaaccttacccgggcttgaattgcaactgaatgatgtgg agacatgtcagccgcaaggcagttgtgaaggtgctgcatggttgtcgtcagctcgtgccgtgaggtgtcggcttaagtgccata acgagcgcaacccttatcgatagttaccatcaggttatgctggggactctgtcgagactgccgtcgtaagatgtgaggaaggtg gggatgacgtcaaatcagcacggcccttacgtccggggctacacacgtgttacaatgggggtacagaaggcagctacacg gcgacgtgatgctaatcccgaaagcctctctcagttcggattggagtctgcaacccgactccatgaagctggattcgctagtaat cgcgcatcagccacggcgcggtgaatacgttcccgggccttgtacacaccgcccgtcaagccatgaaagccgggggtacct gaagtgcgtaaccgcaaggagcgccctagggtaaaactggtgattggggctaagtcgtaacaaggtagccgtaccggaagg tgcggctggaacacctcctt |
| *Bacteroides _uniformis* | SEQ ID NO: 194 | actgagacacggtccaaactcctacgggaggcagcagtgaggaatattggtcaatggacgagagtctgaaccagccaagta gcgtgaaggatgactgccctatgggttgtaaacttcttttatacgggaataaagtgaggcacgtgtgccttttttgtatgtaccgtat gaataaggatcggctaactccgtgccagcagccgcggtaatacggaggatccgagcgttatccggatttattgggtttaaagg gagcgtaggcggacgcttaagtcagttgtgaaagtttgcggctcaaccgtaaaattgcagttgatactgggtgtcttgagtacag tagaggcaggcggaattcgtggtgtagcggtgaaatgcttagatatcacgaagaactccgattgcgaaggcagcttgctggac tgtaactgacgctgatgctcgaaagtgtgggtatcaaacaggattagataccctggtagtccacacagtaaacgatgaatacte gctgtttgcgatatacagtaagcggccaagcgaaagcgttaagtattccacctggggagtacgccggcaacggtgaaactcaa aggaattgacgggggcccgcacaagcggaggaacatgtggtttaattcgatgatacgcgaggaaccttacccgggcttgaatt |

TABLE 5-continued

| Full length 16S rDNA sequences of species (negative correlates) | | |
|---|---|---|
| Species Name | Sequence Identifier | 16S rDNA sequence |
| | | gcaactgaatgatgtggagacatgtcagccgcaaggcagttgtgaaggtgctgcatggttgtcgtcagctcgtgccgtgaggt<br>gtcggcttaagtgccataacgagcgcaacccttatcgatagttaccatcaggttatgctggggactctgtcgagactgccgtcgt<br>aagatgtgaggaaggtggggatgacgtcaaatcagcacggcccttacgtccggggctacacacgtgttacaatggggggtac<br>agaaggcagctacacggcgacgtgatgctaatcccgaaagcctctctcagttcggattggagtctgcaacccgactccatgaa<br>gctggattcgctagtaatcgcgcatcagccacggcgcggtgaatacgttcccgggccttgtacacaccgcccgtcaagccatg<br>aaagccgggggtacctgaagtgcgtaaccgcaaggagcgccctagggtaaaactggtgattggggctaagtcgtaacaagg<br>tagccgtaccggaaggtgcggctggaacacctcctt |
| *Bacteroides _uniformis* | SEQ ID NO: 195 | atgaagagtttgatcctggctcaggatgaacgctagctacaggcttaacacatgcaagtcgaggggcagcatgaacttagcttg<br>ctaagtttgatggcgaccggcgcacgggtgagtaacacgtatccaacctgccgatgactcggggatagcctttcgaaagaaa<br>gattaatacccgatggcatagttcttccgcatggtagaactattaaagaatttcggtcatcgatggggatgcgttccattaggttgtt<br>ggcggggtaacggcccaccaagccttcgatggatagggggttctgagaggaaggtcccccacattggaactgagacacggtc<br>caaactcctacgggaggcagcagtgaggaatattggtcaatggacgagagtctgaaccagccaagtagcgtgaaggatgact<br>gccctatgggttgtaaacttcttttatacgggaataaagtgaggcacgtgtgcctttttgtatgtaccgtatgaataaggatcggcta<br>actccgtgccagcagccgcggtaatacggaggatccgagcgttatccggatttattgggtttaaagggagcgtaggcggacg<br>cttaagtcagttgtgaaagtttgcggctcaaccgtaaaattgcagttgatactgggtgtcttgagtacagtagaggcaggcggaa<br>ttcgtggtgtagcggtgaaatgcttagatatcacgaagaactccgattgcgaaggcagcttgctggactgtaactgacgctgatg<br>ctcgaaagtgtgggtatcaaacaggattagataccctggtagtccacacagtaaacgatgaatactcgctgtttgcgatatacag<br>taagcggccaagcgaaagcgttaagtattccacctggggagtacgccggcaacggtgaaactcaaaggaattgacgggggc<br>ccgcacaagcggaggaacatgtggtttaattcgatgatacgcgaggaaccttacccgggcttgaattgcaactgaatgatgtgg<br>agacatgtcagccgcaaggcagttgtgaaggtgctgcatggttgtcgtcagctcgtgccgtgaggtgtcggcttaagtgccata<br>acgagcgcaacccttatcgatagttaccatcaggttatgctggggactctgtcgagactgccgtcgtaagatgtgaggaaggtg<br>gggatgacgtcaaatcagcacggcccttacgtccggggctacacacgtgttacaatggggggtacagaaggcagctacacg<br>gcgacgtgatgctaatcccgaaagcctctctcagttcggattggagtctgcaacccgactccatgaagctggattcgctagtaat<br>cgcgcatcagccacggcgcggtgaatacgttcccgggccttgtacacaccgcccgtcaagccatgaaagccgggggtacct<br>gaagtgcgtaaccgcaaggagcgccctagggtaaaactggtgattggggctaagtcgtaacaaggtagccgtaccggaagg<br>tgcggctggaacacctcctt |
| *Bacteroides _uniformis* | SEQ ID NO: 196 | atgaagagtttgatcctggctcaggatgaacgctagctacaggcttaacacatgcaagtcgaggggcagcatgaacttagcttg<br>ctaagtttgatggcgaccggcgcacgggtgagtaacacgtatccaacctgccgatgactcggggatagcctttcgaaagaaa<br>gattaatacccgatggcatagttcttccgcatggtggaactattaaagaatttcggtcatcgatggggatgcgttccattaggttgtt<br>ggcggggtaacggcccaccaagccttcgatggatagggggttctgagaggaaggtcccccacattggaactgagacacggtc<br>caaactcctacgggaggcagcagtgaggaatattggtcaatggacgagagtctgaaccagccaagtagcgtgaaggatgact<br>gccctatgggttgtaaacttcttttatacgggaataaagtgaggcacgtgtgcctttttgtatgtaccgtatgaataaggatcggcta<br>actccgtgccagcagccgcggtaatacggaggatccgagcgttatccggatttattgggtttaaagggagcgtaggcggacg<br>cttaagtcagttgtgaaagtttgcggctcaaccgtaaaattgcagttgatactgggtgtcttgagtacagtagaggcaggcggaa<br>ttcgtggtgtagcggtgaaatgcttagatatcacgaagaactccgattgcgaaggcagcttgctggactgtaactgacgctgatg<br>ctcgaaagtgtgggtatcaaacaggattagataccctggtagtccacacagtaaacgatgaatactcgctgtttgcgatatacag<br>taagcggccaagcgaaagcgttaagtattccacctggggagtacgccggcaacggtgaaactcaaaggaattgacgggggc<br>ccgcacaagcggaggaacatgtggtttaattcgatgatacgcgaggaaccttacccgggcttgaattgcaactgaatgatgtgg<br>agacatgtcagccgcaaggcagttgtgaaggtgctgcatggttgtcgtcagctcgtgccgtgaggtgtcggcttaagtgccata<br>acgagcgcaacccttatcgatagttaccatcaggttatgctggggactctgtcgagactgccgtcgtaagatgtgaggaaggtg<br>gggatgacgtcaaatcagcacggcccttacgtccggggctacacacgtgttacaatggggggtacagaaggcagctacacg<br>gcgacgtgatgctaatcccgaaagcctctctcagttcggattggagtctgcaacccgactccatgaagctggattcgctagtaat<br>cgcgcatcagccacggcgcggtgaatacgttcccgggccttgtacacaccgcccgtcaagccatgaaagccgggggtacct<br>gaagtgcgtaaccgcaaggagcgccctagggtaaaactggtgattggggctaagtcgtaacaaggtagccgtaccggaagg<br>tgcggctggaacacctcctt |

TABLE 5-continued

Full length 16S rDNA sequences of species (negative correlates)

| Species Name | Sequence Identifier | 16S rDNA sequence |
| --- | --- | --- |
| *Bacteroides _uniformis* | SEQ ID NO: 197 | atgaagagtttgatcctggctcaggatgaacgctagctacaggcttaacacatgcaagtcgaggggcagcatgaacttagcttg<br>ctaagtttgatggcgaccggcgcacgggtgagtaacacgtatccaacctgccgatgactcggggatagcctttcgaaagaaa<br>gattaatacccgatggcatagttcttccgcatggtagaactattaaagaatttcggtcatcgatggggatgcgttccattaggttgtt<br>ggcggggtaacggcccaccaagccttcgatggataggggttctgagaggaaggtcccccacattggaactgagacacggtc<br>caaactcctacgggaggcagcagtgaggaatattggtcaatggacgagagtctgaaccagccaagtagcgtgaaggatgact<br>gccctatgggttgtaaacttcttttatacgggaataaagtgaggcacgtgtgcctttttgtatgtaccgtatgaataaggatcggcta<br>actccgtgccagcagccgcggtaatacggaggatccgagcgttatccggatttattgggtttaaagggagcgtaggcggacg<br>cttaagtcagttgtgaaagtttgcggctcaaccgtaaaattgcagttgatactgggtgtcttgagtacagtagaggcaggcggaa<br>ttcgtggtgtagcggtgaaatgcttagatatcacgaagaactccgattgcgaaggcagcttgctggactgtaactgacgctgatg<br>ctcgaaagtgtgggtatcaaacaggattagataccctggtagtccacacagtaaacgatgaatactcgctgtttgcgatatacag<br>taagcggccaagcgaaagcgttaagtattccacctggggagtacgccggcaacggtgaaactcaaaggaattgacgggggc<br>ccgcacaagcggaggaacatgtggtttaattcgatgatacgcgaggaaccttacccgggcttgaattgcaactgaatgatgtgg<br>agacatgtcagccgcaaggcagttgtgaaggtgctgcatggttgtcgtcagctcgtgccgtgaggtgtcggcttaagtgccata<br>acgagcgcaacccttatcgatagttaccatcaggttatgctggggactctgtcgagactgccgtcgtaagatgtgaggaaggtg<br>gggatgacgtcaaatcagcacggcccttacgtccggggctacacacgtgttacaatgggggtacagaaggcagctacacg<br>gcgacgtgatgctaatcccgaaagcctctctcagttcggattggagtctgcaacccgactccatgaagctggattcgctagtaat<br>cgcgcatcagccacggcgcggtgaatacgttcccgggccttgtacacaccgcccgtcaagccatgaaagccgggggtacct<br>gaagtgcgtaaccgcaaggagcgccctagggtaaaactggtgattggggctaagtcgtaacaaggtagccgtaccggaagg<br>tgcggctggaacacctcctt |
| *Bacteroides _uniformis* | SEQ ID NO: 198 | atgaagagtttgatcctggctcaggatgaacgctagctacaggcttaacacatgcaagtcgaggggcagcatgaacttagcttg<br>ctaagtttgatggcgaccggcgcacgggtgagtaacacgtatccaacctgccgatgactcggggatagcctttcgaaagaaa<br>gattaatacccgatggcatagttcttccgcatggtagaactattaaagaatttcggtcatcgatggggatgcgttccattaggttgtt<br>ggcggggtaacggcccaccaagccttcgatggataggggttctgagaggaaggtcccccacattggaactgagacacggtc<br>caaactcctacgggaggcagcagtgaggaatattggtcaatggacgagagtctgaaccagccaagtagcgtgaaggatgact<br>gccctatgggttgtaaacttcttttatacgggaataaagtgaggcacgtgtgcctttttgtatgtaccgtatgaataaggatcggcta<br>actccgtgccagcagccgcggtaatacggaggatccgagcgttatccggatttattgggtttaaagggagcgtaggcggacg<br>cttaagtcagttgtgaaagtttgcggctcaaccgtaaaattgcagttgatactgggtgtcttgagtacagtagaggcaggcggaa<br>ttcgtggtgtagcggtgaaatgcttagatatcacgaagaactccgattgcgaaggcagcttgctggactgtaactgacgctgatg<br>ctcgaaagtgtgggtatcaaacaggattagataccctggtagtccacacagtaaacgatgaatactcgctgtttgcgatatacag<br>taagcggccaagcgaaagcgttaagtattccacctggggagtacgccggcaacggtgaaactcaaaggaattgacgggggc<br>ccgcacaagcggaggaacatgtggtttaattcgatgatacgcgaggaaccttacccgggcttgaattgcaactgaatgatgtgg<br>agacatgtcagccgcaaggcagttgtgaaggtgctgcatgttgtcgtcagctcgtgccgtgaggtgtcggcttaagtgccata<br>acgagcgcaacccttatcgatagttaccatcaggttatgctggggactctgtcgagactgccgtcgtaagatgtgaggaaggtg<br>gggatgacgtcaaatcagcacggcccttacgtccggggctacacacgtgttacaatgggggtacagaaggcagctacacg<br>gcgacgtgatgctaatcccgaaagcctctctcagttcggattggagtctgcaacccgactccatgaagctggattcgctagtaat<br>cgcgcatcagccacggcgcggtgaatacgttcccgggccttgtacacaccgcccgtcaagccatgaaagccgggggtacct<br>gaagtgcgtaaccgcaaggagcgccctagggtaaaactggtgattggggctaagtcgtaacaaggtagccgtaccggaagg<br>tgcggctggaacacctcctt |
| *Bacteroides _vulgatus* | SEQ ID NO: 199 | tttgcatgtactttatgaataaggatcggctaactccgtgccagcagccgcggtaatacggaggatccgagcgttatccggattt<br>attgggtttaaagggagcgtagatggatgtttaagtcagttgtgaaagtttgcggctcaaccgtaaaattgcagttgatactggat<br>atcttgagtgcagttgaggcaggcggaattcgtggtgtagcggtgaaatgcttagatatcacgaagaactccgattgcgaaggc<br>agcctgctaagctgcaactgacattgaggctcgaaagtgtgggtatcaaacaggattagataccctggtagtccacacggtaaa<br>cgatgaatactcgctgtttgcgatatacggcaagcggccaagcgaaagcgttaagtattccacctggggagtacgccggcaac<br>ggtgaaactcaaaggaattgacgggggcccgcacaagcggaggaacatgtggtttaattcgatgatacgcgaggaaccttac<br>ccgggcttaaattgcagatgaattacggtgaaagccgtaagccgcaaggcatctgtgaaggtgctgcatggttgtcgtcagctc<br>gtgccgtgaggtgtcggcttaagtgccataacgagcgcaacccttgttgtcagttactaacaggttctgctgaggactctgacaa |

TABLE 5-continued

Full length 16S rDNA sequences of species (negative correlates)

| Species Name | Sequence Identifier | 16S rDNA sequence |
|---|---|---|
| | | gactgccatcgtaagatgtgaggaaggtggggatgacgtcaaatcagcacggcccttacgtccggggctacacacgtgttac<br>aatgggggtacagagggccgctaccacgcgagtggatgccaatcccaaaaacctctctcagttcggactggagtctgcaac<br>ccgactccacgaagctggattcgctagtaatcgcgcatcagccacggcgcggtgaatacgttcccgggccttgtacacaccgc<br>ccgtcaagccatgggagccgggggtacctgaagtgcgtaaccgcgaggagcgccctagggtaaaactggtgactggggct<br>aagtcgtaacaaggtagccgtaccggaaggtgcggctggaacacctccttt |
| *Bacteroides _vulgatus* | SEQ ID NO: 200 | atgaagagtttgatcctggctcaggatgaacgctagctacaggcttaacacatgcaagtcgaggggcagcatggtcttagcttg<br>ctaaggccgatggcgaccggcgcacgggtgagtaacacgtatccaacctgccgtctactcttggacagccttctgaaaggaa<br>gattaatacaagatggcatcatgagttcacatgttcacatgattaaaggtattccggtagacgatggggatgcgttccattagata<br>gtaggcggggtaacggcccacctagtcttcgatggataggggttctgagaggaaggtcccccacattggaactgagacacgg<br>tccaaactcctacgggaggcagcagtgaggaatattggtcaatgggcgagagcctgaaccagccaagtagcgtgaaggatg<br>actgccctatgggttgtaaacttcttttataaaggaataaagtcgggtatggatacccgtttgcatgtactttatgaataaggatcgg<br>ctaactccgtgccagcagccgcggtaatacggaggatccgagcgttatccggatttattgggtttaaagggagcgtagatggat<br>gtttaagtcagttgtgaaagtttgcggctcaaccgtaaaattgcagttgatactggatatcttgagtgcagttgaggcaggcggaa<br>ttcgtggtgtagcggtgaaatgcttagatatcacgaagaactccgattgcgaaggcagcctgctaagctgcaactgacattgag<br>gctcgaaagtgtgggtatcaaacaggattagataccctggtagtccacacggtaaacgatgaatactcgctgtttgcgatatacg<br>gcaagcggccaagcgaaagcgttaagtattccacctggggagtacgccggcaacggtgaaactcaaaggaattgacgggg<br>gcccgcacaagcggaggaacatgtggtttaattcgatgatacgcgaggaaccttacccgggcttaaattgcagatgaattacg<br>gtgaaagccgtaagccgcaaggcatctgtgaaggtgctgcatggttgtcgtcagctcgtgccgtgaggtgtcggcttaagtgc<br>cataacgagcgcaacccttgttgtcagttactaacaggttctgctgaggactctgacaagactgccatcgtaagatgtgaggaa<br>ggtggggatgacgtcaaatcagcacggcccttacgtccggggctacacacgtgttacaatgggggtacagagggccgcta<br>ccacgcgagtggatgccaatcccaaaaacctctctcagttcggactggagtctgcaacccgactccacgaagctggattcgct<br>agtaatcgcgcatcagccacggcgcggtgaatacgttcccgggccttgtacacaccgcccgtcaagccatgggagccgggg<br>gtacctgaagtgcgtaaccgcgaggagcgccctagggtaaaactggtgactggggctaagtcgtaacaaggtagccgtacc<br>ggaaggtgcggctggaacacctcctt |
| *Bacteroides _vulgatus* | SEQ ID NO: 201 | atgaagagtttgatcctggctcaggatgaacgctagctacaggcttaacacatgcaagtcgaggggcagcatggtcttagcttg<br>ctaaggccgatggcgaccggcgcacgggtgagtaacacgtatccaacctgccgtctactcttggacagccttctgaaaggaa<br>gattaatacaagatggcatcatgagtccgcatgttcacatgattaaaggtattccggtaggcgatggggatgcgttccattagata<br>gtaggcggggtaacggcccacctagtcttcgatggataggggttctgagaggaaggtcccccacattggaactgagacacgg<br>tccaaactcctacgggaggcagcagtgaggaatattggtcaatgggcgagagcctgaaccagccaagtagcgtgaaggatg<br>actgccctatgggttgtaaacttcttttataaaggaataaagtcgggtatgtatacccgtttgcatgtactttatgaataaggatcgg<br>ctaactccgtgccagcagccgcggtaatacggaggatccgagcgttatccggatttattgggtttaaagggagcgtagatggat<br>gtttaagtcagttgtgaaagtttgcggctcaaccgtaaaattgcagttgatactggatatcttgagtgcagttgaggcaggcggaa<br>ttcgtggtgtagcggtgaaatgcttagatatcacgaagaactccgattgcgaaggcagcctgctaagctgcaactgacattgag<br>gctcgaaagtgtgggtatcaaacaggattagataccctggtagtccacacggtaaacgatgaatactcgctgtttgcgatataca<br>gcaagcggccaagcgaaagcgttaagtattccacctggggagtacgccggcaacggtgaaactcaaaggaattgacgggg<br>gcccgcacaagcggaggaacatgtggtttaattcgatgatacgcgaggaaccttacccgggcttaaattgcagatgaattacg<br>gtgaaagccgtaagccgcaaggcatctgtgaaggtgctgcatggttgtcgtcagctcgtgccgtgaggtgtcggcttaagtgc<br>cataacgagcgcaacccttgttgtcagttactaacaggttctgctgaggactctgacaagactgccatcgtaagatgtgaggaa<br>ggtggggatgacgtcaaatcagcacggcccttacgtccggggctacacacgtgttacaatgggggtacagagggccgcta<br>ccacgcgagtggatgccaatcccaaaaacctctctcagttcggactggagtctgcaacccgactccacgaagctggattcgct<br>agtaatcgcgcatcagccacggcgcggtgaatacgttcccgggccttgtacacaccgcccgtcaagccatgggagccgggg<br>gtacctgaagtgcgtaaccgcgaggagcgccctagggtaaaactggtgactggggctaagtcgtaacaaggtagccgtacc<br>ggaaggtgcggctggaacacctcctt |

TABLE 5-continued

| Full length 16S rDNA sequences of species (negative correlates) | | |
|---|---|---|
| Species Name | Sequence Identifier | 16S rDNA sequence |
| *Bacteroides _vulgatus* | SEQ ID NO: 202 | atgaagagtttgatcctggctcaggatgaacgctagctacaggcttaacacatgcaagtcgaggggcagcatggtcttagcttg ctaaggccgatggcgaccggcgcacgggtgagtaacacgtatccaacctgccgtctactcttggacagccttctgaaaggaa gattaatacaagatggcatcatgagtccgcatgttcacatgattaaaggtattccggtagacgatggggatgcgttccattagata gtaggcggggtaacggcccacctagtcttcgatggataggggttctgagaggaaggtcccccacattggaactgagacacgg tccaaactcctacgggaggcagcagtgaggaatattggtcaatgggcgcaggcctgaaccagccaagtagcgtgaaggatg actgccctatgggttgtaaacttcttttataaaggaataaagtcgggtatgcatacccgtttgcatgtactttatgaataaggatcgg ctaactccgtgccagcagccgcggtaatacggaggatccgagcgttatccggatttattgggtttaaagggagcgtagatggat gtttaagtcagttgtgaaagtttgcggctcaaccgtaaaattgcagttgatactggatatcttgagtgcagttgaggcaggcggaa ttcgtggtgtagcggtgaaatgcttagatatcacgaagaactccgattgcgaaggcagcctgctaagctgcaactgacattgag gctcgaaagtgtgggtatcaaacaggattagataccctggtagtccacacggtaaacgatgaatactcgctgtttgcgatataca gcaagcggccaagcgaaagcgttaagtattccacctggggagtacgccggcaacggtgaaactcaaaggaattgacgggg gcccgcacaagcggaggaacatgtggtttaattcgatgatacgcgaggaaccttacccgggcttaaattgcagatgaattacg gtgaaagccgtaagccgcaaggcatctgtgaaggtgctgcatggttgtcgtcagctcgtgccgtgaggtgtcggcttaagtgc cataacgagcgcaacccttgttgtcagttactaacaggttccgctgaggactctgacaagactgccatcgtaagatgtgaggaa ggtggggatgacgtcaaatcagcacggcccttacgtccggggctacacacgtgttacaatgggggtacagagggtcgctac cacgcgagtggatgccaatccccaaaacctctctcagttcggactggagtctgcaacccgactccacgaagctggattcgcta gtaatcgcgcatcagccacggcgcggtgaatacgttcccgggccttgtacacaccgcccgtcaagccatgggagccggggg tacctgaagtgcgtaaccgcgaggagcgccctagggtaaaactggtgactggggctaagtcgtaacaaggtagccgtaccg gaaggtgcggctggaacacctcctt |
| *Bacteroides _vulgatus* | SEQ ID NO: 203 | atgaagagtttgatcctggctcaggatgaacgctagctacaggcttaacacatgcaagtcgaggggcagcatggtcttagcttg ctaaggccgatggcgaccggcgcacgggtgagtaacacgtatccaacctgccgtctactcttggacagccttctgaaaggaa gattaatacaagatggcatcatgagtccgcatgttcacatgattaaaggtattccggtagacgatggggatgcgttccattagata gtaggcggggtaacggcccacctagtcttcgatggataggggttctgagaggaaggtcccccacattggaactgagacacgg tccaaactcctacgggaggcagcagtgaggaatattggtcaatgggcgagagcctgaaccagccaagtagcgtgaaggatg actgccctatgggttgtaaacttcttttataaaggaataaagtcgggtatggatacccgtttgcatgtactttatgaataaggatcgg ctaactccgtgccagcagccgcggtaatacggaggatccgagcgttatccggatttattgggtttaaagggagcgtagatggat gtttaagtcagttgtgaaagtttgcggctcaaccgtaaaattgcagttgatactggatatcttgagtgcagttgaggcaggcggaa ttcgtggtgtagcggtgaaatgcttagatatcacgaagaactccgattgcgaaggcagcctgctaagctgcaactgacattgag gctcgaaagtgtgggtatcaaacaggattagataccctggtagtccacacggtaaacgatgaatactcgctgtttgcgatataca gcaagcggccaagcgaaagcgttaagtattccacctggggagtacgccggcaacggtgaaactcaaaggaattgacgggg gcccgcacaagcggaggaacatgtggtttaattcgatgatacgcgaggaaccttacccgggcttaaattgcagatgaattacg gtgaaagccgtaagccgcaaggcatctgtgaaggtgctgcatggttgtcgtcagctcgtgccgtgaggtgtcggcttaagtgc cataacgagcgcaacccttgagtcagttactaacaggttctgctgaggactctgacaagactgccatcgtaagatgtgaggaa ggtggggatgacgtcaaatcagcacggcccttacgtccggggctacacacgtgttacaatgggggtacagagggccgcta ccacgcgagtggatgccaatcccaaaaacctctctcagttcggactggagtctgcaacccgactccacgaagctggattcgct agtaatcgcgcatcagccacggcgcggtgaatacgttcccgggccttgtacacaccgcccgtcaagccatgggagccgggg gtacctgaagtgcgtaaccgcgaggagcgccctagggtaaaactggtgactggggctaagtcgtaacaaggtagccgtacc ggaaggtgcggctggaacacctcctt |
| *Bacteroides _vulgatus* | SEQ ID NO: 204 | ccgtttgcatgtactttatgaataaggatcggctaactccgtgccagcagccgcggtaatacggaggatccgagcgttatccgg atttattgggtttaaagggagcgtagatggatgtttaagtcagttgtgaaagtttgcggctcaaccgtaaaattgcagttgatactg gatatcttgagtgcagttgaggcaggcggaattcgtggtgtagcggtgaaatgcttagatatcacgaagaactccgattgcgaa ggcagcctgctaagctgcaactgacattgaggctcgaaagtgtgggtatcaaacaggattagataccctggtagtccacacgg taaacgatgaatactcgctgtttgcgatatacagcaagcggccaagcgaaagcgttaagtattccacctggggagtacgccgg caacggtgaaactcaaaggaattgacgggggcccgcacaagcggaggaacatgtggtttaattcgatgatacgcgaggaac cttacccgggcttaaattgcagatgaattacggtgaaagccgtaagccgcaaggcatctgtgaaggtgctgcatggttgtcgtc |

TABLE 5-continued

Full length 16S rDNA sequences of species (negative correlates)

| Species Name | Sequence Identifier | 16S rDNA sequence |
|---|---|---|
| | | agctcgtgccgtgaggtgtcggcttaagtgccataacgagcgcaacccttgttgtcagttactaacaggttctgctgaggactct<br>gacaagactgccatcgtaagatgtgaggaaggtggggatgacgtcaaatcagcacggcccttacgtccggggctacacacgt<br>gttacaatggggggtacagagggccgctaccacgcgagtggatgccaatccccaaaacctctctcagttcggactggagtct<br>gcaacccgactccacgaagctggattcgctagtaatcgcgcatcagccacggcgcggtgaatacgttcccgggccttgtacac<br>accgcccgtcaagccatgggagccgggggtacctgaagtgcgtaaccgcgaggagcgccctagggtaaaactggtgactg<br>gggctaagtcgtaacaaggtagccgtaccggaaggtgcggctggaacacctccttt |
| *Eubacterium* _sp_3_1_31 | SEQ ID NO: 205 | atggagagtttgatcctggctcaggatgaacgctggcggcatgcctaatacatgcaagtcgaacgaagtctttaggaagcttgc<br>ttccaaagagacttagtggcgaacgggtgagtaacacgtaggtaacctgcccatgtgcccgggataactgctggaaacggta<br>gctaaaaccggataggtatgagggaggcatcacctcatattaaagcaccttcgggtgtgaacatggatggacctgcggcgcat<br>tagctggttggtgaggtaacggcccaccaaggcgatgatgcgtagccgacctgagagggtgaacggccacattgggactga<br>gacacggcccaaactcctacgggaggcagcagtagggaattttcgtcaatgggggaaccctgaacgagcaatgccgcgtg<br>tgtgaagaaggtcttcggatcgtaaagcactgttgtaagtgaagaatgccacatagaggaaatgctatgtgggtgacggtagct<br>taccagaaagccacggctaactacgtgccagcagccgcggtaatacgtaggtggcaagcgttatccggaatcattgggcgta<br>aagggtgcgtaggtggcacgataagtctgaagtaaaaggcaacagctcaactgttgtatgctttggaaactgtcgagctagagt<br>gcagaagagggcgatggaattccatgtgtagcggtaaaatgcgtagatatatggaggaacaccagtggcgaaggcggtcgc<br>ctggtctgtaactgacactgatgcacgaaagcgtggggagcaaataggattagataccctagtagtccacgccgtaaacgatg<br>agaactaagtgttggagagattcagtgctgcagttaacgcaataagttctccgcctggggagtatgcacgcaagtgtgaaactc<br>aaaggaattgacgggggcccgcacaagcggtggagtatgtggtttaattcgaagcaacgcgaagaaccttaccaggccttga<br>catggatataaatgttctagagatagaaagatagctatatatcacacaggtggtgcatggttgtcgtcagctcgtgtcgtgagatg<br>ttgggttaagtcccgcaacgagcgcaacccttgtcttctgttaccagcattaggttggggactcaggagagactgccggtgaca<br>aaccggaggaaggtggggatgacgtcaaatcatcatgccccttatggcctgggctacacacgtactacaatggcgcctacaaa<br>gage agcgacaccgcgaggtggagcgaatctcataaagggcgtctcagttcggattgaagtctgcaactcgacttcatgaagt<br>cggaatcgctagtaatcgcagate agcatgctgcggtgaatacgttctcgggccttgtacacaccgcccgtcaaaccatggga<br>gttggtaatacccgaagccggtggcataaccgcaaggagtgagccgtcgaaggtaggaccgatgactggggttaagtcgtaa<br>caaggtatccctacgggaacgtggggatggatcacctccttt |
| *Eubacterium* _sp_3_1_31 | SEQ ID NO: 206 | atggagagtttgatcctggctcaggatgaacgctggcggcatgcctaatacatgcaagtcgaacgaagtctttaggaagcttgc<br>ttccaaagagacttagtggcgaacgggtgagtaacacgtaggtaacctgcccatgtgcccgggataactgctggaaacggta<br>gctaaaaccggataggtatgagggaggcatcttcctcatattaaagcaccttcgggtgtgaacatggatggacctgcggcgcat<br>tagctggttggtgaggtaacggcccaccaaggcgatgatgcgtagccgacctgagagggtgaacggccacattgggactga<br>gacacggcccaaactcctacgggaggcagcagtagggaattttcgtcaatgggggaaccctgaacgagcaatgccgcgtg<br>tgtgaagaaggtcttcggatcgtaaagcactgttgtaagtgaagaatgccacatagaggaaatgctatgtgggtgacggtagct<br>taccagaaagccacggctaactacgtgccagcagccgcggtaatacgtaggtggcaagcgttatccggaatcattgggcgta<br>aagggtgcgtaggtggcacgataagtctgaagtaaaaggcaacagctcaactgttgtatgctttggaaactgtcgagctagagt<br>gcagaagagggcgatggaattccatgtgtagcggtaaaatgcgtagatatatggaggaacaccagtggcgaaggcggtcgc<br>ctggtctgtaactgacactgatgcacgaaagcgtggggagcaaataggattagataccctagtagtccacgccgtaaacgatg<br>agaactaagtgttggagagattcagtgctgcagttaacgcaataagttctccgcctggggagtatgcacgcaagtgtgaaactc<br>aaaggaattgacgggggcccgcacaagcggtggagtatgtggtttaattcgaagcaacgcgaagaaccttaccaggccttga<br>catggatataaatgttctagagatagaaagatagctatatatcacacaggtggtgcatggttgtcgtcagctcgtgtcgtgagatg<br>ttgggttaagtcccgcaacgagcgcaacccttgtcttctgttaccagcattaggttggggactcaggagagactgccggtgaca<br>aaccggaggaaggtggggatgacgtcaaatcatcatgccccttatggcctgggctacacacgtactacaatggcgcctacaaa<br>gagcagcgacaccgcgaggtggagcgaatctcataaagggcgtctcagttcggattgaagtctgcaactcgacttcatgaagt<br>cggaatcgctagtaatcgcagate agcatgctgcggtgaatacgttctcgggccttgtacacaccgcccgtcaaaccatggga<br>gttggtaatacccgaagccggtggcataaccgcaaggagtgagccgtcgaaggtaggaccgatgactggggttaagtcgtaa<br>caaggtatccctacgggaacgtggggatggatcacctccttt |

TABLE 5-continued

Full length 16S rDNA sequences of species (negative correlates)

| Species Name | Sequence Identifier | 16S rDNA sequence |
|---|---|---|
| *Eubacterium* _sp_3_1_31 | SEQ ID NO: 207 | atggagagtttgatcctggctcaggatgaacgctggcggcatgcctaatacatgcaagtcgaacgaagtctttaggaagcttgc<br>ttccaaagagacttagtggcgaacgggtgagtaacacgtaggtaacctgcccatgtgcccgggataactgctggaaacggta<br>gctaaaaccggataggtatgagggaggcatcttcctcatattaaagcaccttcgggtgtgaacatggatggacctgcggcgcat<br>tagctggttggtgaggtaacggcccaccaaggcgatgatgcgtagccgacctgagagggtgaacggccacattgggactga<br>gacacggcccaaactcctacgggaggcagcagtagggaattttcgtcaatgggggaaccctgaacgagcaatgccgcgtg<br>tgtgaagaaggtcttcggatcgtaaagcactgttgtaagtgaagaatgccatatagaggaaatgctatgtgggtgacggtagctt<br>accagaaagccacggctaactacgtgccagcagccgcggtaatacgtaggtggcaagcgttatccggaatcattgggcgtaa<br>agggtgcgtaggtggcacgataagtctgaagtaaaaggcaacagctcaactgttgtatgctttggaaactgtcgagctagagtg<br>cagaagagggcgatggaattccatgtgtagcggtaaaatgcgtagatatatggaggaacaccagtggcgaaggcggtcgcct<br>ggtctgtaactgacactgatgcacgaaagcgtggggagcaaataggattagataccctagtagtccacgccgtaaacgatgag<br>aactaagtgttggagagattcagtgctgcagttaacgcaataagttctccgcctggggagtatgcacgcaagtgtgaaactcaa<br>aggaattgacgggggcccgcacaagcggtggagtatgtggtttaattcgaagcaacgcgaagaaccttaccaggccttgaca<br>tggatataaatgttctagagatagaaagatagctatatatcacacaggtggtgcatggttgtcgtcagctcgtgtcgtgagatgttg<br>ggttaagtcccgcaacgagcgcaacccttgtcttctgttaccagcattaggttggggactcaggagagactgccggtgacaaa<br>ccggaggaaggtggggatgacgtcaaatcatcatgccccttatggcctgggctacacacgtactacaatggcgcctacaaag<br>agcagcgacaccgcgaggtgaagcgaatctcataaagggcgtctcagttcggattgaagtctgcaactcgacttcatgaagtc<br>ggaatcgctagtaatcgcagatcagcatgctgcggtgaatacgttctcgggccttgtacacaccgcccgtcaaaccatgggag<br>ttggtaatacccgaagccggtggcataaccgcaaggagtgagccgtcgaaggtaggaccgatgactggggttaagtcgtaac<br>aaggtatccctacgggaacgtggggatggatcacctccttt |
| *Eubacterium* _sp_3_1_31 | SEQ ID NO: 208 | atggagagtttgatcctggctcaggatgaacgctggcggcatgcctaatacatgcaagtcgaacgaagtctttaggaagcttgc<br>ttccaaagagacttagtggcgaacgggtgagtaacacgtaggtaacctgcccatgtgcccgggataactgctggaaacggta<br>gctaaaaccggataggtatgagggaggcatcttcctcatattaaagcaccttcgggtgtgaacatggatggacctgcggcgcat<br>tagctggttggtgaggtaacggcccaccaaggcgatgatgcgtagccgacctgagagggtgaacggccacattgggactga<br>gacacggcccaaactcctacgggaggcagcagtagggaattttcgtcaatgggggaaccctgaacgagcaatgccgcgtg<br>tgtgaagaaggtcttcggatcgtaaagcactgttgtaagtgaagaatgccacatagaggaaatgctatgtgggtgacggtagct<br>taccagaaagccacggctaactacgtgccagcagccgcggtaatacgtaggtggcaagcgttatccggaatcattgggcgta<br>aagggtgcgtaggtggcacgataagtctgaagtaaaaggcaacagctcaactgttgtatgctttggaaactgtcgagctagagt<br>gcagaagagggcgatggaattccatgtgtagcggtaaaatgcgtagatatatggaggaacaccagtggcgaaggcggtcgc<br>ctggtctgtaactgacactgatgcacgaaagcgtggggagcaaataggattagataccctagtagtccacgccgtaaacgatg<br>agaactaagtgttggagagattcagtgctgcagttaacgcaataagttctccgcctggggagtatgcacgcaagtgtgaaactc<br>aaaggaattgacgggggcccgcacaagcggtggagtatgtggtttaattcgaagcaacgcgaagaaccttaccaggccttga<br>catggatataaatgttctagagatagaaagatagctatatatcacacaggtggtgcatggttgtcgtcagctcgtgtcgtgagatg<br>ttgggttaagtcccgcaacgagcgcaacccttgtcttctgttaccagcattaagttggggactcaggagagactgccggtgaca<br>aaccggaggaaggtggggatgacgtcaaatcatcatgccccttatggcctgggctacacacgtactacaatggcgcctacaaa<br>gagcagcgacaccgcgaggtggagcgaatctcataaagggcgtctcagttcggattgaagtctgcaactcgacttcatgaagt<br>cggaatcgctagtaatcgcagatcagcatgctgcggtgaatacgttctcgggccttgtacacaccgcccgtcaaaccatggga<br>gttggtaatacccgaagccggtggcataaccgcaaggagtgagccgtcgaaggtaggaccgatgactggggttaagtcgtaa<br>caaggtatccctacgggaacgtggggatggatcacctccttt |
| *Eubacterium* _sp_3_1_31 | SEQ ID NO: 209 | atggagagtttgatcctggctcaggatgaacgctggcggcatgcctaatacatgcaagtcgaacgaagtctttaggaagcttgc<br>ttccaaagagacttagtggcgaacgggtgagtaacacgtaggtaacctgcccatgtgcccgggataactgctggaaacggta<br>gctaaaaccggataggtatgagggaggcatcttcctcatattaaagcaccttcgggtgtgaacatggatggacctgcggcgcat<br>tagctggttggtgaggtaacggcccaccaaggcgatgatgcgtagccgacctgagagggtgaacggccacattgggactga<br>gacacggcccaaactcctacgggaggcagcagtagggaattttcgtcaatgggggaaccctgaacgagcaatgccgcgtg<br>tgtgaagaaggtcttcggatcgtaaagcactgttgtaagtgaagaatgccatatagaggaaatgctatgtgggtgacggtagctt<br>accagaaagccacggctaactacgtgccagcagccgcggtaatacgtaggtggcaagcgttatccggaatcattgggcgtaa |

TABLE 5-continued

Full length 16S rDNA sequences of species (negative correlates)

| Species Name | Sequence Identifier | 16S rDNA sequence |
|---|---|---|
| | | agggtgcgtaggtggcacgataagtctgaagtaaaaggcaacagctcaactgttgtatgctttggaaactgtcgagctagagtg cagaagagggcgatggaattccatgtgtagcggtaaaatgcgtagatatatggaggaacaccagtggcgaaggcggtcgcct ggtctgtaactgacactgatgcacgaaagcgtggggagcaaataggattagataccctagtagtccacgccgtaaacgatgag aactaagtgttggagagattcagtgctgcagttaacgcaataagttctccgcctggggagtatgcacgcaagtgtgaaactcaa aggaattgacgggggcccgcacaagcggtggagtatgtggtttaattcgaagcaacgcgaagaaccttaccaggccttgaca tggatataaatgttctagagatagaaagatagctatatatcacacaggtggtgcatggttgtcgtcagctcgtgtcgtgagatgttg ggttaagtcccgcaacgagcgcaacccttgtcttctgttaccagcattaggttggggactcaggagagactgccggtgacaaa ccggaggaaggtggggatgacgtcaaatcatcatgccccttatggcctgggctacacacgtactacaatggcgcctacaaag agcagcgacaccgcgaggtggagcgaatctcataaagggcgtctcagttcggattgaagtctgcaactcgacttcatgaagtc ggaatcgctagtaatcgcagatcagcatgctgcggtgaatacgttctcgggccttgtacacaccgcccgtcaaaccatgggag ttggtaatacccgaagccggtggcataaccgcaaggagtgagccgtcgaaggtaggaccgatgactggggttaagtcgtaac aaggtatccctacgggaacgtggggatggatcacctccttt |
| *Streptococcus_salivarius* | SEQ ID NO: 210 | aatgagagtttgatcctggctcaggacgaacgctggcggcgtgcctaatacatgcaagtagaacgctgaagagaggagcttg ctcttcttggatgagttgcgaacgggtgagtaacgcgtaggtaacctgccttgtagcgggggataactattggaaacgatagct aataccgcataacaatgggtgacacatgtcatttatttgaaaggggcaattgctccactacaagatggacctgcgttgtattagct agtaggtgaggtaacggctcacctaggcgacgatacatagccgacctgagagggtgatcggccacactgggactgagacac ggcccagactcctacgggaggcagcagtagggaatcttcggcaatgggggcaaccctgaccgagcaacgccgcgtgagtg aagaaggttttcggatcgtaaagctctgttgtaagtcaagaacgagtgtgagagtggaaagttcacactgtgacggtagcttacc agaaagggacggctaactacgtgccagcagccgcggtaatacgtaggtcccgagcgttgtccggatttattgggcgtaaagc gagcgcaggcggtttgataagtctgaagttaaaggctgtggctcaaccatagttcgctttggaaactgtcaaacttgagtgcaga aggggagagtggaattccatgtgtagcggtgaaatgcgtagatatatggaggaacaccggtggcgaaagcggctctctggtc tgtaactgacgctgaggctcgaaagcgtggggagcgaacaggattagataccctggtagtccacgccgtaaacgatgagtgc taggtgttggatcctttccgggattcagtgccgcagctaacgcattaagcactccgcctggggagtacgaccgcaaggttgaaa ctcaaaggaattgacgggggcccgcacaagcggtggagcatgtggtttaattcgaagcaacgcgaagaaccttaccaggtct tgacatcccgatgctatttctagagatagaaagttacttcggtacatcggtgacaggtggtgcatggttgtcgtcagctcgtgtcgt gagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggttggt acaacgagttgcgagtcggtgacggcaagctaatctcttaaagccaatctcagttcggattgtaggctgcaactcgcctacatg aagtcggaatcgctagtaatcgcggatcagcacgccgcggtgaatacgttcccgggccttgtacacaccgcccgtcacacca cgagagtttgtaacacccgaagtcggtgaggtaaccttttggagccagccgcctaaggtgggatagatgattggggtgaagtc gtaacaaggtagccgtatcggaaggtgcggctggatcacctcctt |
| *Streptococcus_salivarius* | SEQ ID NO: 211 | aatgagagtttgatcctggctcaggacgaacgctggcggcgtgcctaatacatgcaagtagaacgctgaagagaggagcttg ctcttcttggatgagttgcgaacgggtgagtaacgcgtaggtaacctgccttgtagcgggggataactattggaaacgatagct aataccgcataacaatgaatgactcatgtcatttatttgaaaggggcaattgctccactacaagatggacctgcgttgtattagcta gtaggtgaggtaacggctcacctaggcgacgatacatagccgacctgagagggtgatcggccacactgggactgagacacg gcccagactcctacgggaggcagcagtagggaatcttcggcaatgggggcaaccctgaccgagcaacgccgcgtgagtga agaaggttttcggatcgtaaagctctgttgtaagtcaagaacgagtgtgagagtggaaagttcacactgtgacggtagcttacca gaaagggacggctaactacgtgccagcagccgcggtaatacgtaggtcccgagcgttgtccggatttattgggcgtaaagcg agcgcaggcggtttgataagtctgaagttaaaggctgtggctcaaccatagttcgctttggaaactgtcaaacttgagtgcagaa ggggagagtggaattccatgtgtagcggtgaaatgcgtagatatatggaggaacaccggtggcgaaagcggctctctggtct gtaactgacgctgaggctcgaaagcgtggggagcgaacaggattagataccctggtagtccacgccgtaaacgatgagtgct aggtgttggatcctttccgggattcagtgccgcagctaacgcattaagcactccgcctggggagtacgaccgcaaggttgaaa ctcaaaggaattgacgggggcccgcacaagcggtggagcatgtggtttaattcgaagcaacgcgaagaaccttaccaggtct tgacatcccgatgctatttctagagatagaaagttacttcggtacatcggtgacaggtggtgcatggttgtcgtcagctcgtgtcgt gagatgttgggttaagtcccgcaacgagcgcaacccctattgttagttgccatcattcagttgggcactctagcgagactgccg gtaataaaccggaggaaggtggggatgacgtcaaatcatcatgccccttatgacctgggctacacacgtgctacaatggttggt |

TABLE 5-continued

Full length 16S rDNA sequences of species (negative correlates)

| Species Name | Sequence Identifier | 16S rDNA sequence |
|---|---|---|
| | | acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |
| *Streptococc us_salivariu s* | SEQ ID NO: 212 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatgaatgactcatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacccgaagtcggtgaggtaaccttttggagccagccgcctaaggtgggatagatgattggggtgaagtc<br>gtaacaaggtagccgtatcggaaggtgcggctggatcacctcctt |
| *Streptococc us_salivariu S* | SEQ ID NO: 213 | aatgagagtttgaccttcctggctcaggacgaacgctggcggcgtgcctaatacatgcaagtagaacgctgaagagaggagc<br>ttgctcttcttggatgagttgcgaacgggtgagtaacgcgtaggtaacctgccttgtagcgggggataactattggaaacgatag<br>ctaataccgcataacaatgaatgactcatgtcatttatttgaaaggggcaattgctccactacaagatggacctgcgttgtattagc<br>tagtaggtgaggtaacggctcacctaggcgacgatacatagccgacctgagagggtgatcggccacactgggactgagaca<br>cggcccagactcctacgggaggcagcagtagggaatcttcggcaatgggggcaaccctgaccgagcaacgccgcgtgagt<br>gaagaaggttttcggatcgtaaagctctgttgtaagtcaagaacgagtgtgagagtggaaagttcacactgtgacggtagcttac<br>cagaaagggacggctaactacgtgccagcagccgcggtaatacgtaggtcccgagcgttgtccggatttattgggcgtaaag<br>cgagcgcaggcggtttgataagtctgaagttaaaggctgtggctcaaccatagttcgctttggaaactgtcaaacttgagtgcag<br>aaggggagagtggaattccatgtgtagcggtgaaatgcgtagatatatggaggaacaccggtggcgaaagcggctctctggt<br>ctgtaactgacgctgaggctcgaaagcgtggggagcgaacaggattagataccctggtagtccacgccgtaaacgatgagtg<br>ctaggtgaggatcctttccgggattcagtgccgcagctaacgcattaagcactccgcctggggagtacgaccgcaaggttgaa<br>actcaaaggaattgacgggggcccgcacaagcggtggagcatgtggtttaattcgaagcaacgcgaagaaccttaccaggtc<br>ttgacatcccgatgctatttctagagatagaaagttacttcggtacatcggtgacaggtggtgcatggttgtcgtcagctcgtgtcg<br>tgagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |

TABLE 5-continued

Full length 16S rDNA sequences of species (negative correlates)

| Species Name | Sequence Identifier | 16S rDNA sequence |
|---|---|---|
| *Streptococc<br>us_salivariu<br>s* | SEQ ID<br>NO: 214 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatgaatgactcatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |
| *Streptococc<br>us_salivariu<br>s* | SEQ ID<br>NO: 215 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatgaatgactcatgtcatttatttgaaaggggcaattgctccactacaagatggacctgcgttgtattagcta<br>gtaggtgaggtaacggctcacctaggcgacgatacatagccgacctgagagggtgatcggccacactgggactgagacacg<br>gcccagactcctacgggaggcagcagtagggaatcttcggcaatgggggcaaccctgaccgagcaacgccgcgtgagtga<br>agaaggttttcggatcgtaaagctctgttgtaagtcaagaacgagtgtgagagtggaaagttcacactgtgacggtagcttacca<br>gaaagggacggctaactacgtgccagcagccgcggtaatacgtaggtcccgagcgttgtccggatttattgggcgtaaagcg<br>agcgcaggcggtttgataagtctgaagttaaaggctgtggctcaaccatagttcgctttggaaactgtcaaacttgagtgcagaa<br>ggggagagtggaattccatgtgtagcggtgaaatgcgtagatatatggaggaacaccggtggcgaaagcggctctctggtct<br>gtaactgacgctgaggctcgaaagcgtggggagcgaacaggattagataccctggtagtccacgccgtaaacgatgagtgct<br>aggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |
| *Streptococc<br>us_salivariu<br>S* | SEQ ID<br>NO: 216 | aatgagagtttgatcctggctcaggacgaacgctggcggcgtgcctaatacatgcaagtagaacgctgaagagaggagcttg<br>ctcttcttggatgagttgcgaacgggtgagtaacgcgtaggtaacctgccttgtagcgggggataactattggaaacgatagct<br>aataccgcataacaatgggtgacacatgtcatttatttgaaaggggcaattgctccactacaagatggacctgcgttgtattagct<br>agtaggtgaggtaacggctcacctaggcgacgatacatagccgacctgagagggtgatcggccacactgggactgagacac<br>ggcccagactcctacgggaggcagcagtagggaatcttcggcaatgggggcaaccctgaccgagcaacgccgcgtgagtg<br>aagaaggttttcggatcgtaaagactgttgtaagtcaagaacgagtgtgagagtggaaagttcacactgtgacggtagcttacc<br>agaaagggacggctaactacgtgccagcagccgcggtaatacgtaggtcccgagcgttgtccggatttattgggcgtaaagc |

TABLE 5-continued

Full length 16S rDNA sequences of species (negative correlates)

| Species Name | Sequence Identifier | 16S rDNA sequence |
|---|---|---|
| | | gagcgcaggcggtttgataagtctgaagttaaaggctgtggctcaaccatagttcgctttggaaactgtcaaacttgagtgcaga<br>aggggagagtggaattccatgtgtagcggtgaaatgcgtagatatatggaggaacaccggtggcgaaagcggctctctggtc<br>tgtaactgacgctgaggctcgaaagcgtggggagcgaacaggattagataccctggtagtccacgccgtaaacgatgagtgc<br>taggtgttggatcctttccgggattcagtgccgcagctaacgcattaagcactccgcctggggagtacgaccgcaaggttgaaa<br>ctcaaaggaattgacgggggcccgcacaagcggtggagcatgtggtttaattcgaagcaacgcgaagaaccttaccaggtct<br>tgacatcccgatgctatttctagagatagaaagttacttcggtacatcggtgacaggtggtgcatggttgtcgtcagctcgtgtcgt<br>gagatgttgggttaagtcccgcaacgagcgcaacccctattgttagttgccatcattcagttgggcactctagcgagactgccg<br>gtaataaaccggaggaaggtggggatgacgtcaaatcatcatgccccttatgacctgggctacacacgtgctacaatggttggt<br>acaacgagttgcgagtcggtgacggcaagctaatctcttaaagccaatctcagttcggattgtaggctgcaactcgcctacatg<br>aagtcggaatcgctagtaatcgcggatcagcacgccgcggtgaatacgttcccgggccttgtacacaccgcccgtcacacca<br>cgagagtttgtaacacccgaagtcggtgaggtaaccttttggagccagccgcctaaggtgggatagatgattggggtgaagtc<br>gtaacaaggtagccgtatcggaaggtgcggctggatcacctcctt |
| *Parabacteroides_distasonis* | SEQ ID NO: 217 | cgaagagtttgatcctggctcaggatgaacgctagcgacaggcttaacacatgcaagtcgaggggcagcacaggtagcaata<br>ccgggtggcgaccggcgcacgggtgagtaacgcgtatgcaacttacctatcagagggggataacccggcgaaagtcggac<br>taataccgcatgaagcaggggtcccgcatggggatatttgctaaagattcatcgctgatagataggcatgcgttccattaggca<br>gttggcggggtaacggcccaccaaaccgacgatggataggggttctgagaggaaggtcccccacattggtactgagacacg<br>gaccaaactcctacgggaggcagcagtgaggaatattggtcaatgggcgtaagcctgaaccagccaagtcgcgtgagggat<br>gaaggttctatggatcgtaaacctcttttataagggaataaagtgcgggacgtgtcctgttttgtatgtaccttatgaataaggatcg<br>gctaactccgtgccagcagccgcggtaatacggaggatccgagcgttatccggatttattgggtttaaagggtgcgtaggcgg<br>ccttttaagtcagcggtgaaagtctgtggctcaaccatagaattgccgttgaaactgggggggcttgagtatgtttgaggcaggcg<br>gaatgcgtggtgtagcggtgaaatgcttagatatcacgcagaaccccgattgcgaaggcagcctgccaagccatgactgacg<br>ctgatgcacgaaagcgtggggatcaaacaggattagataccctggtagtccacgcagtaaacgatgatcactagctgtttgcg<br>atacagtgtaagcggcacagcgaaagcgttaagtgatccacctggggagtacgccggcaacggtgaaactcaaaggaattg<br>acgggggcccgcacaagcggaggaacatgtggtttaattcgatgatacgcgaggaaccttacccgggtttgaacgcattcgg<br>accgaggtggaaacaccttttctagcaatagccgtttgcgaggtgctgcatggttgtcgtcagctcgtgccgtgaggtgtcggct<br>taagtgccataacgagcgcaacccttgccactagttactaacaggtaaagctgaggactctggtgggactgccagcgtaagct<br>gcgaggaaggcggggatgacgtcaaatcagcacggcccttacatccggggcgacacacgtgttacaatggcgtggacaaa<br>gggaggccacctggcgacagggagcgaatccccaaaccacgtctcagttcggatcggagtctgcaacccgactccgtgaag<br>ctggattcgctagtaatcgcgcatcagccatggcgcggtgaatacgttcccgggccttgtacacaccgcccgtcaagccatgg<br>gagccgggggtacctgaagtccgtaaccgcgaggatcggcctagggtaaaactggtgactggggctaagtcgtaacaaggt<br>agccgtaccggaaggtgcggctggaacacctccttt |
| *Parabacteroides_distasonis* | SEQ ID NO: 218 | cgaagagtttgatcctggctcaggatgaacgctagcgacaggcttaacacatgcaagtcgaggggcagcacaggtagcaata<br>ccgggtggcgaccggcgcacgggtgagtaacgcgtatgcaacttgcctatcagagggggataacccggcgaaagtcggac<br>taataccgcatgaagcaggggccccgcatggggatatttgctaaagattcatcgctgatagataggcatgcgttccattaggca<br>gttggcggggtaacggcccaccaaaccgacgatggataggggttctgagaggaaggtcccccacattggtactgagacacg<br>gaccaaactcctacgggaggcagcagtgaggaatattggtcaatgggcgcgagcctgaaccagccaagtcgcgtgagggat<br>gaaggttctatggatcgtaaacctcttttataagggaataaagtgcgggacgtgtcctgttttgtatgtaccttatgaataaggatcg<br>gctaactccgtgccagcagccgcggtaatacggaggatccgagcgttatccggatttattgggtttaaagggtgcgtaggcgg<br>ccttttaagtcagcggtgaaagtctgtggctcaaccatagaattgccgttgaaactgggggggcttgagtatgtttgaggcaggcg<br>gaatgcgtggtgtagcggtgaaatgcttagatatcacgcagaaccccgattgcgaaggcagcctgccaagccatgactgacg<br>ctgatgcacgaaagcgtggggatcaaacaggattagataccctggtagtccacgcagtaaacgatgatcactagctgtttgcg<br>atacagtgtaagcggcacagcgaaagcgttaagtgatccacctggggagtacgccggcaacggtgaaactcaaaggaattg<br>acgggggcccgcacaagcggaggaacatgtggtttaattcgatgatacgcgaggaaccttacccgggtttgaacgcattcgg<br>accgaggtggaaacaccttttctagcaatagccgtttgcgaggtgctgcatggttgtcgtcagctcgtgccgtgaggtgtcggct<br>taagtgccataacgagcgcaacccttgccactagttactaacaggtaaagctgaggactctggtgggactgccagcgtaagct<br>gcgaggaaggcggggatgacgtcaaatcagcacggcccttacatccggggcgacacacgtgttacaatggcgtggacaaa |

TABLE 5-continued

| Full length 16S rDNA sequences of species (negative correlates) | | |
|---|---|---|
| Species Name | Sequence Identifier | 16S rDNA sequence |
| | | gggatgccacctggcgacagggagcgaatccccaaaccacgtctcagttcggatcggagtctgcaacccgactccgtgaag ctggattcgctagtaatcgcgcatcagccatggcgcggtgaatacgttcccgggccttgtacacaccgcccgtcaagccatgg gagccgggggtacctgaagtccgtaaccgaaaggatcggcctagggtaaaactggtgactggggctaagtcgtaacaaggt agccgtaccggaaggtgcggctggaacacctccttt |
| *Parabacteroides_distasonis* | SEQ ID NO: 219 | cgaagagtttgatcctggctcaggatgaacgctagcgacaggcttaacacatgcaagtcgaggggcagcacaggtagcaata ccgggtggcgaccggcgcacgggtgagtaacgcgtatgcaacttacctatcagaggggggataacccggcgaaagtcggac taataccgcatgaagcaggggtcccgcatggggatatttgctaaagattcatcgctgatagataggcatgcgttccattaggca gttggcggggtaacggcccaccaaaccgacgatggatagggggttctgagaggaaggtcccccacattggtactgagacacg gaccaaactcctacgggaggcagcagtgaggaatattggtcaatgggcgcgagcctgaaccagccaagtcgcgtgagggat gaaggttctatggatcgtaaacctcttttataagggaataaagtgcgggacgtgtcctgttttgtatgtaccttatgaataaggatcg gctaactccgtgccagcagccgcggtaatacggaggatccgagcgttatccggatttattgggtttaaagggtgcgtaggcgg ccttttaagtcagcggtgaaagtctgtggctcaaccatagaattgccgttgaaactgggggggcttgagtatgtttgaggcaggcg gaatgcgtggtgtagcggtgaaatgcttagatatcacgcagaaccccgattgcgaaggcagcctgccaagccatgactgacg ctgatgcacgaaagcgtggggatcaaacaggattagataccctggtagtccacgcagtaaacgatgatcactagctgtttgcg atacagtgtaagcggcacagcgaaagcgttaagtgatccacctggggagtacgccggcaacggtgaaactcaaaggaattg acgggggcccgcacaagcggaggaacatgtggtttaattcgatgatacgcgaggaaccttacccgggtttgaacgcattcgg accgaggtggaaacacctttttctagcaatagccgtttgcgaggtgctgcatggttgtcgtcagctcgtgccgtgaggtgtcggct taagtgccataacgagcgcaacccttgccactagttactaacaggtgatgctgaggactctggtgggactgccagcgtaagct gcgaggaaggcggggatgacgtcaaatcagcacggcccttacatccggggcgacacacgtgttacaatggcgtggacaaa gggaagccacctggcgacagggagcgaatccccaaaccacgtctcagttcggatcggagtctgcaacccgactccgtgaag ctggattcgctagtaatcgcgcatcagccatggcgcggtgaatacgttcccgggccttgtacacaccgcccgtcaagccatgg gagccgggggtacctgaagtccgtaaccgaaaggatcggcctagggtaaaactggtgactggggctaagtcgtaacaaggt agccgtaccggaaggtgcggctggaacacctccttt |
| *Parabacteroides_distasonis* | SEQ ID NO: 220 | cgaagagtttgatcctggctcaggatgaacgctagcgacaggcttaacacatgcaagtcgaggggcagcgggggtagcaat acccgccggcgaccggcgcacgggtgagtaacgcgtatgcaacttacctatcagaggggggataacccggcgaaagtcgga ctaataccgcatgaagcaggggccccgcatggggatatttgctaaagattcatcgctgatagataggcatgcgttccattaggc agttggcggggtaacggcccaccaaaccgacgatggatagggggttctgagaggaaggtcccccacattggtactgagacac ggaccaaactcctacgggaggcagcagtgaggaatattggtcaatgggcgcgagcctgaaccagccaagtcgcgtgaggg atgaaggttctatggatcgtaaacctcttttataagggaataaagtgcgggacgtgtcctgttttgtatgtaccttatgaataaggat cggctaactccgtgccagcagccgcggtaatacggaggatccgagcgttatccggatttattgggtttaaagggtgcgtaggc ggccttttaagtcagcggtgaaagtctgtggctcaaccatagaattgccgttgaaactgggggggcttgagtatgtttgaggcagg cggaatgcgtggtgtagcggtgaaatgcttagatatcacgcagaaccccgattgcgaaggcagcctgccaagccatgactga cgctgatgcacgaaagcgtggggatcaaacaggattagataccctggtagtccacgcagtaaacgatgatcactagctgtttg cgatacagtgtaagcggcacagcgaaagcgttaagtgatccacctggggagtacgccggcaacggtgaaactcaaaggaat tgacgggggcccgcacaagcggaggaacatgtggtttaattcgatgatacgcgaggaaccttacccgggtttgaacgcattcg gaccgaggtggaaacacctttttctagcaatagccgtttgcgaggtgctgcatggttgtcgtcagctcgtgccgtgaggtgtcgg cttaagtgccataacgagcgcaacccttgccactagttactaacaggtaatgctgaggactctggtgggactgccagcgtaagc tgcgaggaaggcggggatgacgtcaaatcagcacggcccttacatccggggcgacacacgtgttacaatggcgtggacaaa gggaggccacctggcgacagggagcgaatccccaaaccacgtctcagttcggatcggagtctgcaacccgactccgtgaag ctggattcgctagtaatcgcgcatcagccatggcgcggtgaatacgttcccgggccttgtacacaccgcccgtcaagccatgg gagccgggggtacctgaagtccgtaaccgcgaggatcggcctagggtaaaactggtgactggggctaagtcgtaacaaggt agccgtaccggaaggtgcggctggaacacctccttt |

TABLE 5-continued

Full length 16S rDNA sequences of species (negative correlates)

| Species Name | Sequence Identifier | 16S rDNA sequence |
|---|---|---|
| *Parabacteroides_distasonis* | SEQ ID NO: 221 | cgaagagtttgatcctggctcaggatgaacgctagcgacaggcttaacacatgcaagtcgaggggcagcacaggtagcaata ccgggtggcgaccggcgcacgggtgagtaacgcgtatgcaacttacctatcagaggggggataacccggcgaaagtcggac taataccgcatgaagcaggggtcccgcatggggatatttgctaaagattcatcgctgatagataggcatgcgttccattaggca gttggcggggtaacggcccaccaaaccgacgatggatagggggttctgagaggaaggtcccccacattggtactgagacacg gaccaaactcctacgggaggcagcagtgaggaatattggtcaatgggcgtaagcctgaaccagccaagtcgcgtgagggat gaaggttctatggatcgtaaacctcttttataagggaataaagtgcgggacgtgtcctgttttgtatgtaccttatgaataaggatcg gctaactccgtgccagcagccgcggtaatacggaggatccgagcgttatccggatttattgggtttaaagggtgcgtaggcgg ccttttaagtcagcggtgaaagtctgtggctcaaccatagaattgccgttgaaactgggggggcttgagtatgtttgaggcaggcg gaatgcgtggtgtagcggtgaaatgcttagatatcacgcagaaccccgattgcgaaggcagcctgccaagccatgactgacg ctgatgcacgaaagcgtggggatcaaacaggattagataccctggtagtccacgcagtaaacgatgatcactagctgtttgcg atacagtgtaagcggcacagcgaaagcgttaagtgatccacctggggagtacgccggcaacggtgaaactcaaaggaattg acgggggcccgcacaagcggaggaacatgtggtttaattcgatgatacgcgaggaaccttacccgggtttgaacgcattcgg accgaggtggaaacaccttttctagcaatagccgtttgcgaggtgctgcatggttgtcgtcagctcgtgccgtgaggtgtcggct taagtgccataacgagcgcaacccttgccactagttactaacaggtaaagctgaggactctggtgggactgccagcgtaagct gcgaggaaggcggggatgacgtcaaatcagcacggcccttacatccggggcgacacacgtgttacaatggcgtggacaaa gggaagccacctggcgacagggagcgaatccccaaaccacgtctcagttcggatcggagtctgcaacccgactccgtgaag ctggattcgctagtaatcgcgcatcagccatggcgcggtgaatacgttcccgggccttgtacacaccgcccgtcaagccatgg gagccgggggtacctgaagtccgtaaccgcgaggatcggcctagggtaaaactggtgactggggctaagtcgtaacaaggt agccgtaccggaaggtgcggctggaacacctccttt |
| *Clostridiaceae_bacterium_JC118* | SEQ ID NO: 222 | atggagagtttgatcctggctcaggatgaacgctggcggcatgcctaatacatgcaagtcgaacgaagtgaagatagcttgcta ttggaacttagtggcgaacgggtgagtaacacgtagataacctgcctgtatgaccgggataacagttggaaacgactgctaata ccggataggcagagaggaggcatctcttctctgttaaagttgggacacaacgcaaacagatggatctgcggtgcattagctagt tggtgaggtaacggcccaccaaggcgatgatgcatagccggcctgagagggcgaacggccacattgggactgagacacgg cccaaactcctacgggaggcagcagtagggaattttcggcaatgggggaaaccctgaccgagcaatgccgcgtgagtgaag acggccttcgggttgtaaagctctgttgtaagggaagaacggcatagagagggaatgctctatgagtgacggtaccttaccag aaagccacggctaactacgtgccagcagccgcggtaatacgtaggtggcaagcgttatccggaattattgggcgtaaagggt gcgtaggcggcgagataagtctgaggtaaaagcccgtggctcaaccacggtaagccttggaaactgtctggctggagtgcag gagaggacaatggaattccatgtgtagcggtaaaatgcgtagatatatggaggaacaccagtggcgaaggcggttgtctggc ctgtaactgacgctgaagcacgaaagcgtggggagcaaataggattagataccctagtagtccacgccgtaaacgatgagaa ctaagtgttggggaaactcagtgctgcagttaacgcaataagttctccgcctggggagtatgcacgcaagtgtgaaactcaaag gaattgacgggggcccgcacaagcggtggagtatgtggtttaattcgacgcaacgcgaagaaccttaccaggccttgacatg gtatcaaaggccctagagatagggagatagttatggtacacacaggtggtgcatggttgtcgtcagctcgtgtcgtgagatgttg ggttaagtcccgcaacgagcgcaacccttgtttctagttaccaacagtaagatggggactctagagagactgccggtgacaaa ccggaggaaggtggggatgacgtcaaatcatcatgccccttatggcctgggctacacacgtactacaatggcgtctacaaaga gcagcgagcaggtgactgtgagcgaatctcataaaggacgtctcagttcggattgaagtctgcaactcgacttcatgaagtcgg aatcgctagtaatcgcggatcagcatgccgcggtgaatacgttctcgggccttgtacacaccgcccgtcaaaccatgggagtt gataatacccgaagccggtggcctaaccatttatggagggagccgtcgaaggtaggatcgatgactggggttaagtcgtaaca aggtatccctacgggaacgtggggatggatcacctccttt |
| *Anaerostipes_hadrus* | SEQ ID NO: 223 | acctaccctgtacaggggggataacagtcagaaatgactgctaataccgcataagaccacagcaccgcatggtgcaggggtaa aaactccggtggtacaggatggacccgcgtctgattagctggttggtgaggtaacggctcaccaaggcgacgatcagtagcc ggcttgagagagtgaacggccacattgggactgagacacggcccaaactcctacgggaggcagcagtggggaatattgcac aatgggggaaaccctgatgcagcgacgccgcgtgagtgaagaagtatctcggtatgtaaagctctatcagcagggaagaaaa tgacggtacctgactaagaagccccggctaactacgtgccagcagccgcggtaatacgtagggggcaagcgttatccggaat tactgggtgtaaagggtgcgtaggtggtatggcaagtcagaagtgaaaacccagggcttaactctgggactgcttttgaaactg tcagactggagtgcaggagaggtaagcggaattcctagtgtagcggtgaaatgcgtagatattaggaggaacatcagtggcg |

TABLE 5-continued

Full length 16S rDNA sequences of species (negative correlates)

| Species Name | Sequence Identifier | 16S rDNA sequence |
|---|---|---|
| | | aaggcggcttactggactgaaactgacactgaggcacgaaagcgtggggagcaaacaggattagataccctggtagtccac gccgtaaacgatgaatactaggtgtcggggccgtagaggcttcggtgccgcagccaacgcagtaagtattccacctggggag tacgttcgcaagaatgaaactcaaaggaattgacggggacccgcacaagcggtggagcatgtggtttaattcgaagcaacgc gaagaaccttacctggtcttgacatccttctgaccggtccttaaccggacctttccttcgggacaggagagacaggtggtgcatg gttgtcgtcagctcgtgtcgtgagatgttgggttaagtcccgcaacgagcgcaacccctatctttagtagccagca |
| *Clostridium _innocuum* | SEQ ID NO: 224 | atggagagtttgatcctggctcaggatgaacgctggcggcatgcctaatacatgcaagtcgaacgaagactctaggaagcttg cttccaaagagacttagtggcgaacgggtgagtaacacgtaggtaacctgcccatgtgtccgggataactgctggaaacggta gctaaaaccggataggtatacagagcgcatgctcagtatattaaagcgcccatcaaggcgtgaacatggatggacctgcggc gcattagctagttggtgaggtaacggcccaccaaggcgatgatgcgtagccggcctgagagggtaaacggccacattggga ctgagacacggcccaaactcctacgggaggcagcagtagggaattttcgtcaatgggggaaaccctgaacgagcaatgccg cgtgagtgaagaaggtcttcggatcgtaaagctctgttgtaagtgaagaacggctcatagaggaaatgctatgggagtgacgg tagcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcctggggagtatgcacgcaagtgtgaa actcaaaggaattgacgggggcccgcacaagcggtggagtatgtggtttaattcgaagcaacgcgaagaaccttaccaggcc ttgacatggaaacaaataccctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcga ccacaaagagcagcgacttggtgacaagaagcgaatctcataaaggtcgtctcagttcggattgaagtctgcaactcgacttca tgaagtcggaatcgctagtaatcgcagatcagcatgctgcggtgaatacgttctcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctccttt |
| *Clostridium _innocuum* | SEQ ID NO: 225 | atggagagtttgatcctggctcaggatgaacgctggcggcatgcctaatacatgcaagtcgaacgaagtcttcaggaagcttgc ttccaaaaagacttagtggcgaacgggtgagtaacacgtaggtaacctgcccatgtgtccgggataactgctggaaacggtag ctaaaaccggataggtatacggagcgcatgctctgtatattaaagcgcccatcaaggcgtgaacatggatggacctgcggcgc attagctagttggtgaggtaacggcccaccaaggcgatgatgcgtagccggcctgagagggtaaacggccacattgggactg agacacggcccaaactcctacgggaggcagcagtagggaattttcgtcaatgggggaaaccctgaacgagcaatgccgcgt gagtgaagaaggtcttcggatcgtaaagactgttgtaagtgaagaacggctcatagaggaaatgctatgggagtgacggtag cttaccagaaagccacggctaactacgtgccagcagccgcggtaatacgtaggtggcaagcgttatccggaatcattgggcgt aaagggtgcgtaggtggcgtactaagtctgtagtaaaaggcaatggctcaaccattgtaagctatggaaactggtatgctggag tgcagaagagggcgatggaattccatgtgtagcggtaaaatgcgtagatatatggaggaacaccagtggcgaaggcggtcg cctggtctgtaactgacactgaggcacgaaagcgtggggagcaaataggattagataccctagtagtccacgccgtaaacgat gagaactaagtgttggaggaattcagtgctgcagttaacgcaataagttctccgcctggggagtatgcacgcaagtgtgaaact caaaggaattgacgggggcccgcacaagcggtggagtatgtggtttaattcgaagcaacgcgaagaaccttaccaggccttg acatggaaacaaataccctagagatagggggataattatggatcacacaggtggtgcatggttgtcgtcagctcgtgtcgtgag atgttgggttaagtcccgcaacgagcgcaacccttgtcgcatgttaccagcatcaagttggggactcatgcgagactgccggtg acaaaccggaggaaggtggggatgacgtcaaatcatcatgccccttatggcctgggctacacacgtactacaatggcgacca caaagagcagcgacttggtgacaagaagcgaatctcataaaggtcgtctcagttcggattgaagtctgcaactcgacttcatga agtcggaatcgctagtaatcgcagatcagcatgctgcggtgaatacgttctcgggccttgtacacaccgcccgtcaaaccatgg gagtcagtaatacccgaagccggtggcataaccgtaaggagtgagccgtcgaaggtaggaccgatgactggggttaagtcgt aacaaggtatccctacgggaacgtggggatggatcacctccttt |

TABLE 5-continued

Full length 16S rDNA sequences of species (negative correlates)

| Species Name | Sequence Identifier | 16S rDNA sequence |
|---|---|---|
| *Clostridium _innocuum* | SEQ ID NO: 226 | atggagagtttgatcctggctcaggatgaacgctggcggcatgcctaatacatgcaagtcgaacgaagtcttcaggaagcttgc ttccaaaaagacttagtggcgaacgggtgagtaacacgtaggtaacctgcccatgtgtccgggataactgctggaaacggtag ctaaaaccggataggtatacggagcgcatgctctgtatattaaagcgcccttcaaggcgtgaacatggatggacctgcgacgc attagctagttggtgaggtaacggcccaccaaggcgatgatgcgtagccggcctgagagggtaaacggccacattgggactg agacacggcccaaactcctacgggaggcagcagtagggaattttcgtcaatggggaaaccctgaacgagcaatgccgcgt gagtgaagaaggtcttcggatcgtaaagctctgttgtaagtgaagaacggctcatagaggaaatgctatgggagtgacggtag cttaccagaaagccacggctaactacgtgccagcagccgcggtaatacgtaggtggcaagcgttatccggaatcattgggcgt aaagggtgcgtaggtggcgtactaagtctgtagtaaaaggcaatggctcaaccattgtaagctatggaaactggtatgctggag tgcagaagagggcgatggaattccatgtgtagcggtaaaatgcgtagatatatggaggaacaccagtggcgaaggcggtcg cctggtctgtaactgacactgaggcacgaaagcgtggggagcaaataggattagataccctagtagtccacgccgtaaacgat gagaactaagtgttggagaaattcagtgctgcagttaacgcaataagttctccgcctggggagtatgcacgcaagtgtgaaact caaaggaattgacgggggcccgcacaagcggtggagtatgtggtttaattcgaagcaacgcgaagaaccttaccaggccttg acatggaaacaaataccctagagatagggggataattatggatcacacaggtggtgcatggttgtcgtcagctcgtgtcgtgag atgttgggttaagtcccgcaacgagcgcaacccttgtcgcatgttaccagcatcaagttggggactcatgcgagactgccggtg acaaaccggaggaaggtggggatgacgtcaaatcatcatgccccttatggcctgggctacacacgtactacaatggcgacca caaagagcagcgacttggtgacaagaagcgaatctcataaaggtcgtctcagttcggattgaagtctgcaactcgacttcatga agtcggaatcgctagtaatcgcagatcagcatgctgcggtgaatacgttctcgggccttgtacacaccgcccgtcaaaccatgg gagtcagtaatacccgaagccggtggcataaccgtaaggagtgagccgtcgaaggtaggaccgatgactggggttaagtcgt aacaaggtatccctacgggaacgtggggatggatcacctcctttt |
| *Clostridium _innocuum* | SEQ ID NO: 227 | atggagagtttgatcctggctcaggatgaacgctggcggcatgcctaatacatgcaagtcgaacgaagtcttcaggaagcttgc ttccaaaaagacttagtggcgaacgggtgagtaacacgtaggtaacctgcccatgtgtccgggataactgctggaaacggtag ctaaaaccggataggtatacggagcgcatgctcagtatattaaagcgcccatcaaggcgtgaacatggatggacctgcggcg cattagctagttggtgaggtaacggcccaccaaggcgatgatgcgtagccggcctgagagggtaaacggccacattgggact gagacacggcccaaactcctacgggaggcagcagtagggaattttcgtcaatggggaaaccctgaacgagcaatgccgc gtgagtgaagaaggtcttcggatcgtaaagctctgttgtaagtgaagaacggctcatagaggaaatgctatgggagtgacggt agcttaccagaaagccacggctaactacgtgccagcagccgcggtaatacgtaggtggcaagcgttatccggaatcattggg cgtaaagggtgcgtaggtggcgtactaagtctgtagtaaaaggcaatggctcaaccattgtaagctatggaaactggtatgctg gagtgcagaagagggcgatggaattccatgtgtagcggtaaaatgcgtagatatatggaggaacaccagtggcgaaggcgg tcgcctggtctgtaactgacactgaggcacgaaagcgtggggagcaaataggattagataccctagtagtccacgccgtaaac gatgagaactaagtgttggaggaattcagtgctgcagttaacgcaataagttctccgcctggggagtatgcacgcaagtgtgaa actcaaaggaattgacgggggcccgcacaagcggtggagtatgtggtttaattcgaagcaacgcgaagaaccttaccaggcc ttgacatggaaacaaataccctagagatagggggataattatggatcacacaggtggtgcatggttgtcgtcagctcgtgtcgtg agatgttgggttaagtcccgcaacgagcgcaacccttgtcgcatgttaccagcatcaagttggggactcatgcgagactgccg gtgacaaaccggaggaaggtggggatgacgtcaaatcatcatgccccttatggcctgggctacacacgtactacaatggcga ccacaaagagcagcgacttggtgacaagaagcgaatctcataaaggtcgtctcagttcggattgaagtctgcaactcgacttca tgaagtcggaatcgctagtaatcgcagatcagcatgctgcggtgaatacgttctcgggccttgtacacaccgcccgtcaaacca tgggagtcagtaatacccgaagccggtggcataaccgtaaggagtgagccgtcgaaggtaggaccgatgactggggttaag tcgtaacaaggtatccctacgggaacgtggggatggatcacctcctttt |
| *Clostridium _innocuum* | SEQ ID NO: 228 | atggagagtttgatcctggctcaggatgaacgctggcggcatgcctaatacatgcaagtcgaacgaagtctttaggaagcttgc ttccaaaaagacttagtggcgaacgggtgagtaacacgtaggtaacctgcccatgtgtccgggataactgctggaaacggtag ctaaaaccggataggtatacggagcgcatgctctgtatattaaagcgcccatcaaggcgtgaacatggatggacctgcggcgc attagctagttggtgaggtaacggcccaccaaggcgatgatgcgtagccggcctgagagggtaaacggccacattgggactg agacacggcccaaactcctacgggaggcagcagtagggaattttcgtcaatggggaaaccctgaacgagcaatgccgcgt gagtgaagaaggtcttcggatcgtaaagctctgttgtaagtgaagaacggctcatagaggaaatgctatgggagtgacggtag cttaccagaaagccacggctaactacgtgccagcagccgcggtaatacgtaggtggcaagcgttatccggaatcattgggcgt |

TABLE 5-continued

Full length 16S rDNA sequences of species (negative correlates)

| Species Name | Sequence Identifier | 16S rDNA sequence |
|---|---|---|
| | | aaagggtgcgtaggtggcgtactaagtctgtagtaaaaggcaatggctcaaccattgtaagctatggaaactggtatgctggag<br>tgcagaagagggcgatggaattccatgtgtagcggtaaaatgcgtagatatatggaggaacaccagtggcgaaggcggtcg<br>cctggtctgtaactgacactgaggcacgaaagcgtggggagcaaataggattagataccctagtagtccacgccgtaaacgat<br>gagaactaagtgttggaggaattcagtgctgcagttaacgcaataagttctccgcctggggagtatgcacgcaagtgtgaaact<br>caaaggaattgacgggggcccgcacaagcggtggagtatgtggtttaattcgaagcaacgcgaagaaccttaccaggccttg<br>acatggaaacaaataccctagagatagggggataattatggatcacacaggtggtgcatggttgtcgtcagctcgtgtcgtgag<br>atgttgggttaagtcccgcaacgagcgcaacccttgtcgcatgttaccagcatcaagttggggactcatgcgagactgccggtg<br>acaaaccggaggaaggtggggatgacgtcaaatcatcatgccccttatggcctgggctacacacgtactacaatggcgacca<br>caaagagcagcgacttggtgacaagaagcgaatctcataaaggtcgtctcagttcggattgaagtctgcaactcgacttcatga<br>agtcggaatcgctagtaatcgcagatcagcatgctgcggtgaatacgttctcgggccttgtacacaccgcccgtcaaaccatgg<br>gagtcagtaatacccgaagccggtggcataaccgtaaggagtgagccgtcgaaggtaggaccgatgactggggttaagtcgt<br>aacaaggtatccctacgggaacgtggggatggatcacctccttt |
| *Clostridium _hathewayi* | SEQ ID NO: 229 | atgagagttcgatcctggctcaggatgaacgctggcggcgtgcttaacacatgcaagtcgagcgaagcggtttcaatgaagttt<br>tcggatggaattgaaattgacttagcggcggacgggtgagtaacgcgtgggtaacctgccttacactgggggataacagttag<br>aaatgactgctaataccgcataagcgcacagggccgcatggtctggtgtgaaaaactccggtggtgtaagatggacccgcgt<br>ctgattaggtagttggtggggtaacggcccaccaagccgacgatcagtagccgacctgagagggtgaccggccacattggg<br>actgagacacggcccaaactcctacgggaggcagcagtggggaatattggacaatgggcgaaagcctgatccagcgacgc<br>cgcgtgagtgaagaagtatttcggtatgtaaagctctatcagcagggaagaaaatgacggtacctgactaagaagccccggct<br>aactacgtgccagcagccgcggtaatacgtagggggcaagcgttatccggatttactgggtgtaaagggagcgtagacggtt<br>aagcaagtctgaagtgaaagcccggggctcaaccccggtactgctttggaaactgtttgacttgagtgcaggagaggtaagtg<br>gaattcctagtgtagcggtgaaatgcgtagatattaggaggaacaccagtggcgaaggcggcttactggactgtaactgacgtt<br>gaggctcgaaagcgtggggagcaaacaggattagataccctggtagtccacgccgtaaacgatgaatactaggtgtcgggg<br>gacaacgtccttcggtgccgccgctaacgcaataagtattccacctggggagtacgttcgcaagaatgaaactcaaaggaatt<br>gacggggacccgcacaagcggtggagcatgtggtttaattcgaagcaacgcgaagaaccttaccaagtcttgacatcccattg<br>aaaacactttaaccggtgtccctcttcggagcaatggagacaggtggtgcatggttgtcgtcagctcgtgtcgtgagatgttggg<br>ttaagtcccgcaacgagcgcaacccttatccttagtagccagcacatgatggtgggcactctggggagactgccagggataac<br>ctggaggaaggtggggatgacgtcaaatcatcatgccccttatgatttgggctacacacgtgctacaatggcgtaaacaaagg<br>gaagcaaaggagcgatctggagcaaaccccaaaaataacgtctcagttcggattgcaggctgcaactcgcctgcatgaagct<br>ggaatcgctagtaatcgcgaatcagaatgtcgcggtgaatacgttcccgggtcttgtacacaccgcccgtcacaccatgggag<br>ttggtaacgcccgaagtcagtgacccaaccgcaaggagggagctgccgaaggcgggactgataactggggtgaagtcgta<br>acaaggtagccgtatcggaaggtgcggctggatcacctccttt |
| *Clostridium _hathewayi* | SEQ ID NO: 230 | atgagagttcgatcctggctcaggatgaacgctggcggcgtgcttaacacatgcaagtcgagcgaagcggtttcaatgaagttt<br>tcggatggatttgaaattgacttagcggcggacgggtgagtaacgcgtgggtaacctgccttacactgggggataacagttag<br>aaatgactgctaataccgcataagcgcacagggccgcatggtctggtgtgaaaaactccggtggtgtaagatggacccgcgt<br>ctgattaggtagttggtggggtaacggcccaccaagccgacgatcagtagccgacctgagagggtgaccggccacattggg<br>actgagacacggcccaaactcctacgggaggcagcagtggggaatattggacaatgggcgaaagcctgatccagcgacgc<br>cgcgtgagtgaagaagtatttcggtatgtaaagctctatcagcagggaagaaaatgacggtacctgactaagaagccccggct<br>aactacgtgccagcagccgcggtaatacgtagggggcaagcgttatccggatttactgggtgtaaagggagcgtagacggtt<br>aagcaagtctgaagtgaaagcccggggctcaaccccggtactgctttggaaactgtttgacttgagtgcaggagaggtaagtg<br>gaattcctagtgtagcggtgaaatgcgtagatattaggaggaacaccagtggcgaaggcggcttactggactgtaactgacgtt<br>gaggctcgaaagcgtggggagcaaacaggattagataccctggtagtccacgccgtaaacgatgaatactaggtgtcgggg<br>gacaaagtccttcggtgccgccgctaacgcaataagtattccacctggggagtacgttcgcaagaatgaaactcaaaggaatt<br>gacggggacccgcacaagcgg |

TABLE 5-continued

Full length 16S rDNA sequences of species (negative correlates)

| Species Name | Sequence Identifier | 16S rDNA sequence |
| --- | --- | --- |
| *Clostridium _clostridioforme* | SEQ ID NO: 231 | atgagagtttgatcctggctcaggatgaacgctggcggcgtgcctaacacatgcaagtcgaacgaagcaattaaaggaagttttcggacggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccttttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggcggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt |
| *Clostridium _clostridioforme* | SEQ ID NO: 232 | atgagagtttgatcctggctcaggatgaacgctggcggcgtgcctaacacatgcaagtcgaacgaagcaattaaaggaagttttcggatggaatttgattgactgagtggcggacgggtgagtaacgcgtggataacctgcctcacactgggggataacagttagaaatgactgctaataccgcataagcgcacagtgccgcatggtacggtgtgaaaaactccggtggtgtgagatggatccgcgtctgattagccagaggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttgggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt |
| *Clostridium _clostridioforme* | SEQ ID NO: 233 | atgagagtttgatcctggctcaggatgaacgctggcggcgtgcctaacacatgcaagtcgaacgaagcaattaaaggaagttttcggatggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaa |

TABLE 5-continued

| Species Name | Sequence Identifier | 16S rDNA sequence |
|---|---|---|
| | | gcaagtctgaagtgaaaacccagggctcaaccctgggactgctttggaaactgttttgctagagtgtcggagaggtaagtgga<br>attcctagtgtagcggtgaaatgcgtagatattaggaggaacaccagtggcgaaggcggcttactggacgataactgacgttg<br>aggctcgaaagcgtggggagcaaacaggattagataccctggtagtccacgccgtaaacgatgaatgctaggtgttgggg<br>gcaaagcccttcggtgccgtcgcaaacgcagtaagcattccacctggggagtacgttcgcaagaatgaaactcaaaggaattg<br>acggggacccgcacaagcggtggagcatgtggtttaattcgaagcaacgcgaagaaccttaccaagtcttgacatcctcttgg<br>ccggcgtgtaacggcgccttcccttcggggcaagagagacaggtggtgcatggttgtcgtcagctcgtgtcgtgagatgttgg<br>gttaagtcccgcaacgagcgcaacccttatccttagtagccagcaggtagagctgggcactctagggagactgccagggata<br>acctggaggaaggtggggatgacgtcaaatcatcatgccccttatgatttgggctacacacgtgctacaatggcgtaaacaaa<br>gggaagcaagacagtgatgtggagcaaatcccaaaaataacgtcccagttcggactgtagtctgcaacccgactacacgaag<br>ctggaatcgctagtaatcgcgaatcagaatgtcgcggtgaatacgttcccgggtcttgtacacaccgcccgtcacaccatggga<br>gtcagcaacgcccgaagtcagtgacccaactcgcaagagagggagctgccgaaggcggggcaggtaactggggtgaagt<br>cgtaacaaggtagccgtatcggaaggtgcggctggatcacctccttt |
| *Lactobacillu s_fermentu m* | SEQ ID NO: 234 | tatgagagtttgatcctggctcaggatgaacgccggcggtgtgcctaatacatgcaagtcgaacgcgttggcccgattgattgat<br>ggtgcttgcacctgattgattttggtcgccaacgagtggcggacgggtgagtaacacgtaggtaacctgcccagaagcgggg<br>gacaacatttggaaacagatgctaataccgcataacaacgttgttcgcatgaacaacgcttaaaagatggcttctcgctatcactt<br>ctggatggacctgcggtgcattagcttgttggtggggtaacggcctaccaaggcgatgatgcatagccgagttgagagactga<br>tcggccacaatgggactgagacacggcccatactcctacgggaggcagcagtagggaatcttccacaatgggcgcaagcct<br>gatggagcaacaccgcgtgagtgaagaagggtttcggctcgtaaagctctgttgttaaagaagaacacgtatgagagtaactg<br>ttcatacgttgacggtatttaaccagaaagtcacggctaactacgtgccagcagccgcggtaatacgtaggtggcaagcgttat<br>ccggatttattgggcgtaaagagagtgcaggcggttttctaagtctgatgtgaaagccttcggcttaaccggagaagtgcatcg<br>gaaactggataacttgagtgcagaagagggtagtggaactccatgtgtagcggtggaatgcgtagatatatggaagaacacca<br>gtggcgaaggcggctacctggtctgcaactgacgctgagactcgaaagcatgggtagcgaacaggattagataccctggtag<br>tccatgccgtaaacgatgagtgctaggtgttggagggtttccgcccttcagtgccggagctaacgcattaagcactccgcctgg<br>ggagtacgaccgcaaggttgaaactcaaaggaattgacgggggcccgcacaagcggtggagcatgtggtttaattcgaagct<br>acgcgaagaaccttaccaggtcttgacatcttgcgccaaccctagagatagggcgtttccttcgggaacgcaatgacaggtgg<br>tgcatggtcgtcgtcagctcgtgtcgtgagatgttgggttaagtcccgcaacgagcgcaacccttgttactagttgccagcattaa<br>gttgggcactctagtgagactgccggtgacaaaccggaggaaggtggggacgacgtcagatcatcatgccccttatgacctg<br>ggctacacacgtgctacaatggacggtacaacgagtcgcgaactcgcgagggcaagcaaatctcttaaaaccgttctcagttc<br>ggactgcaggctgcaactcgcctgcacgaagtcggaatcgctagtaatcgcggatcagcatgccgcggtgaatacgttcccg<br>ggccttgtacacaccgcccgtcacaccatgagagtttgtaacacccaaagtcggtggggtaacctttttaggagccagccgcct<br>aaggtgggacagatgattagggtgaagtcgtaacaaggtagccgtaggagaacctgcggctggatcacctccttt |
| *Lactobacillu s_fermentu m* | SEQ ID NO: 235 | tatgagagtttgatcctggctcaggatgaacgccggcggtgtgcctaatacatgcaagtcgaacgcgttggcccaattgattga<br>cggtgcttgcacctgattgattttggtcgccaacgagtggcggacgggtgagtaacacgtaggtaacctgcccagaagcggg<br>ggacaacatttggaaacagatgctaataccgcataacaacgttgttcgcatgaacaacgcttaaaagatggcttctcgctatcact<br>tctggatggacctgcggtgcattagcttgttggtggggtaacggcctaccaaggcgatgatgcatagccgagttgagagactg<br>atcggccacaatgggactgagacacggcccatactcctacgggaggcagcagtagggaatcttccacaatgggcgcaagcc<br>tgatggagcaacaccgcgtgagtgaagaagggtttcggctcgtaaagctctgttgttaaagaagaacacgtatgagagtaact<br>gttcatacgttgacggtatttaaccagaaagtcacggctaactacgtgccagcagccgcggtaatacgtaggtggcaagcgtta<br>tccggatttattgggcgtaaagagagtgcaggcggttttctaagtctgatgtgaaagccttcggcttaaccggagaagtgcatcg<br>gaaactggataacttgagtgcagaagagggtagtggaactccatgtgtagcggtggaatgcgtagatatatggaagaacacca<br>gtggcgaaggcggctacctggtctgcaactgacgctgagactcgaaagcatgggtagcgaacaggattagataccctggtag<br>tccatgccgtaaacgatgagtgctaggtgttggagggtttccgcccttcagtgccggagctaacgcattaagcactccgcctgg<br>ggagtacgaccgcaaggttgaaactcaaaggaattgacgggggcccgcacaagcggtggagcatgtggtttaattcgaagct<br>acgcgaagaaccttaccaggtcttgacatcttgcgccaaccctagagatagggcgtttccttcgggaacgcaatgacaggtgg<br>tgcatggtcgtcgtcagctcgtgtcgtgagatgttgggttaagtcccgcaacgagcgcaacccttgttactagttgccagcattaa<br>gttgggcactctagtgagactgccggtgacaaaccggaggaaggtggggacgacgtcagatcatcatgccccttatgacctg |

TABLE 5-continued

Full length 16S rDNA sequences of species (negative correlates)

| Species Name | Sequence Identifier | 16S rDNA sequence |
|---|---|---|
| | | ggctacacacgtgctacaatggacggtacaacgagtcgcgaactcgcgagggcaagcaaatctcttaaaaccgttctcagttc ggactgcaggctgcaactcgcctgcacgaagtcggaatcgctagtaatcgcggatcagcatgccgcggtgaatacgttcccg ggccttgtacacaccgcccgtcacaccatgagagtttgtaacacccaaagtcggtggggtaacctttttaggagccagccgcct aaggtgggacagatgattagggtgaagtcgtaacaaggtagccgtaggagaacctgcggctggatcacctccttt |
| *Lactobacillus_fermentum* | SEQ ID NO: 236 | tatgagagtttgatcctggctcaggatgaacgccggcggtgtgcctaatacatgcaagtcgaacgcgttggcccaattgattgat ggtgcttgcacctgattgattttggtcgccaacgagtggcggacgggtgagtaacacgtaggtaacctgcccagaagcgggg gacaacatttggaaacagatgctaataccgcataacaacgttgttcgcatgaacaacgcttaaaagatggcttctcgctatcactt ctggatggacctgcggtgcattagcttgttggtggggtaacggcctaccaaggcgatgatgcatagccgagttgagagactga tcggccacaatgggactgagacacggcccatactcctacgggaggcagcagtagggaatcttccacaatgggcgcaagcct gatggagcaacaccgcgtgagtgaagaagggtttcggctcgtaaagctctgttgttaaagaagaacacgtatgagagtaactg ttcatacgttgacggtatttaaccagaaagtcacggctaactacgtgccagcagccgcggtaatacgtaggtggcaagcgttat ccggatttattgggcgtaaagagagtgcaggcggttttctaagtctgatgtgaaagccttcggcttaaccggagaagtgcatcg gaaactggataacttgagtgcagaagagggtagtggaactccatgtgtagcggtggaatgcgtagatatatggaagaacacca gtggcgaaggcggctacctggtctgcaactgacgctgagactcgaaagcatgggtagcgaacaggattagataccctggtag tccatgccgtaaacgatgagtgctaggtgttggagggtttccgcccttcagtgccggagctaacgcattaagcactccgcctgg ggagtacgaccgcaaggttgaaactcaaaggaattgacgggggcccgcacaagcggtggagcatgtggtttaattcgaagct acgcgaagaaccttaccaggtcttgacatcttgcgccaaccctagagatagggcgtttccttcgggaacgcaatgacaggtgg tgcatggtcgtcgtcagctcgtgtcgtgagatgttgggttaagtcccgcaacgagcgcaacccttgttactagttgccagcattaa gttgggcactctagtgagactgccggtgacaaaccggaggaaggtggggacgacgtcagatcatcatgccccttatgacctg ggctacacacgtgctacaatggacggtacaacgagtcgcgaactcgcgagggcaagcaaatctcttaaaaccgttctcagttc ggactgcaggctgcaactcgcctgcacgaagtcggaatcgctagtaatcgcggatcagcatgccgcggtgaatacgttcccg ggccttgtacacaccgcccgtcacaccatgagagtttgtaacacccaaagtcggtggggtaacctttttaggagccagccgcct aaggtgggacagatgattagggtgaagtcgtaacaaggtagccgtaggagaacctgcggctggatcacctccttt |
| *Lactobacillus_fermentum* | SEQ ID NO: 237 | tatgagagtttgatcctggctcaggatgaacgccggcggtgtgcctaatacatgcaagtcgaacgcgttggtccaattgattgac ggtgcttgcacctgattgattttggtcgccaacgagtggcggacgggtgagtaacacgtaggtaacctgcccagaagcgggg gacaacatttggaaacagatgctaataccgcataacaacgttgttcgcatgaacaacgtttaaaagatggcttctcgctatcactt ctggatggacctgcggtgcattagcttgaggtggggtaatggcctaccaaggcgatgatgcatagccgagttgagagactgat cggccacaatgggactgagacacggcccatactcctacgggaggcagcagtagggaatcttccacaatgggcgcaagcctg atggagcaacaccgcgtgagtgaagaagggtttcggctcgtaaagctctgttgttaaagaagaacacgtatgagagtaactgtt catacgttgacggtatttaaccagaaagtcacggctaactacgtgccagcagccgcggtaatacgtaggtggcaagcgttatcc ggatttattgggcgtaaagagagtgcaggcggttttctaagtctgatgtgaaagccttcggcttaaccggagaagtgcatcgga aactggataacttgagtgcagaagagggtagtggaactccatgtgtagcggtggaatgcgtagatatatggaagaacaccagt ggcgaaggcggctacctggtctgcaactgacgctgagactcgaaagcatgggtagcgaacaggattagataccctggtagtc catgccgtaaacgatgagtgctaggtgttggagggtttccgcccttcagtgccggagctaacgcattaagcactccgcctggg gagtacgaccgcaaggttgaaactcaaaggaattgacgggggcccgcacaagcggtggagcatgtggtttaattcgaagcta cgcgaagaaccttaccaggtcttgacatcttgcgccaaccctagagatagggcgtttccttcgggaacgcaatgacaggtggt gcatggtcgtcgtcagctcgtgtcgtgagatgttgggttaagtcccgcaacgagcgcaacccttgttactagttgccagcattaa gttgggcactctagtgagactgccggtgacaaaccggaggaaggtggggacgacgtcagatcatcatgccccttatgacctg ggctacacacgtgctacaatggacggtacaacgagtcgcaaactcgcgagggcaagcaaatctcttaaaaccgttctcagttc ggactgcaggctgcaactcgcctgcacgaagtcggaatcgctagtaatcgcggatcagcatgccgcggtgaatacgttcccg ggccttgtacacaccgcccgtcacaccatgagagtttgtaacacccaaagtcggtggggtaacctttttaggagccagccgcct aaggtgggacagatgattagggtgaagtcgtaacaaggtagccgtaggagaacctgcggctggatcacctcctt |
| *Lactobacillus_fermentum* | SEQ ID NO: 238 | tatgagagtttgatcctggctcaggatgaacgccggcggtgtgcctaatacatgcaagtcgaacgcgttggcccaattgattgat ggtgcttgcacctgattgattttggtcgccaacgagtggcggacgggtgagtaacacgtaggtaacctgcccagaagcgggg gacaacatttggaaacagatgctaataccgcataacaacgttgttcgcatgaacaacgcttaaaagatggcttctcgctatcactt |

TABLE 5-continued

Full length 16S rDNA sequences of species (negative correlates)

| Species Name | Sequence Identifier | 16S rDNA sequence |
| --- | --- | --- |
| | | ctggatggacctgcgctgcattagcttgttggtggggtaatggcctaccaaggcgatgatgcatagccgagttgagagactgat<br>cggccacaatgggactgagacacggcccatactcctacgggaggcagcagtagggaatcttccacaatgggcgcaagcctg<br>atggagcaacaccgcgtgagtgaagaagggtttcggctcgtaaagctctgttgttaaagaagaacacgtatgagagtaactgtt<br>catacgttgacggtatttaaccagaaagtcacggctaactacgtgccagcagccgcggtaatacgtaggtggcaagcgttatcc<br>ggatttattgggcgtaaagagagtgcaggcggttttctaagtctgatgtgaaagccttcggcttaaccggagaagtgcatcgga<br>aactggataacttgagtgcagaagagggtagtggaactccatgtgtagcggtggaatgcgtagatatatggaagaacaccagt<br>ggcgaaggcggctacctggtctgcaactgacgctgagactcgaaagcatgggtagcgaacaggattagataccctggtagtc<br>catgccgtaaacgatgagtgctaggtgttggagggtttccgcccttcagtgccggagctaacgcattaagcactccgcctggg<br>gagtacgaccgcaaggttgaaactcaaaggaattgacgggggcccgcacaagcggtggagcatgtggtttaattcgaagcta<br>cgcgaagaaccttaccaggtcttgacatcttgcgccaaccctagagatagggcgtttccttcgggaacgcaatgacaggtggt<br>gcatggtcgtcgtcagctcgtgtcgtgagatgttgggttaagtcccgcaacgagcgcaacccttgttactagttgccagcattaa<br>gttgggcactctagtgagactgccggtgacaaaccggaggaaggtggggacgacgtcagatcatcatgccccttatgacctg<br>ggctacacacgtgctacaatggacggtacaacgagtcgcgaactcgtgagggcaagcaaatctcttaaaaccgttctcagttc<br>ggactgcaggctgcaactcgcctgcacgaagtcggaatcgctagtaatcgcggatcagcatgccgcggtgaatacgttcccg<br>ggccttgtacacaccgcccgtcacaccatgagagtttgtaacacccaaagtcggtggggtaacctttttaggagccagccgcct<br>aaggtgggacagatgattagggtgaagtcgtaacaaggtagccgtaggagaacctgcggctggatcacctcctt |
| *Bacteroides _thetaiotao micron* | SEQ ID NO: 239 | ctgaaccagccaagtagcgtgaaggatgactgccctatgggttgtaaacttcttttatatgggaataaagttttccacgtgtggaat<br>tttgtatgtaccatatgaataaggatcggctaactccgtgccagcagccgcggtaatacggaggatccgagcgttatccggattt<br>attgggtttaaagggagcgtaggtggacagttaagtcagttgtgaaagtttgcggctcaaccgtaaaattgcagttgatactggct<br>gtcttgagtacagtagaggtgggcggaattcgtggtgtagcggtgaaatgcttagatatcacgaagaactccgattgcgaagg<br>cagctcactggactgcaactgacactgatgctcgaaagtgtgggtatcaaacaggattagataccctggtagtccacacagtaa<br>acgatgaatactcgctgtttgcgatatacagtaagcggccaagcgaaagcattaagtattccacctggggagtacgccggcaa<br>cggtgaaactcaaaggaattgacgggggcccgcacaagcggaggaacatgtggtttaattcgatgatacgcgaggaacctta<br>cccgggcttaaattgcatttgaatatattggaaacagtatagccgtaaggcaaatgtgaaggtgctgcatggttgtcgtcagctcg<br>tgccgtgaggtgtcggcttaagtgccataacgagcgcaacccttatctttagttactaacaggtcatgctgaggactctagagag<br>actgccgtcgtaagatgtgaggaaggtggggatgacgtcaaatcagcacggcccttacgtccggggctacacacgtgttaca<br>atggggggtacagaaggcagctacctggtgacaggatgctaatcccaaaagcctctctcagttcggatcgaagtctgcaaccc<br>gacttcgtgaagctggattcgctagtaatcgcgcatcagccatggcgcggtgaatacgttcccgggccttgtacacaccgccc<br>gtcaagccatgaaagccgggggtacctgaagtacgtaaccgcaaggagcgtcctagggtaaaactggtaattggggctaagt<br>cgtaacaaggtagccgtaccggaaggtgcggctggaacacctcctt |
| *Bacteroides _thetaiotao micron* | SEQ ID NO: 240 | ctgaaccagccaagtagcgtgaaggatgactgccctatgggttgtaaacttcttttatatgggaataaagttttccacgtgtggaat<br>tttgtatgtaccatatgaataaggatcggctaactccgtgccagcagccgcggtaatacggaggatccgagcgttatccggattt<br>attgggtttaaagggagcgtaggtggacagttaagtcagttgtgaaagtttgcggctcaaccgtaaaattgcagttgatactggct<br>gtcttgagtacagtagaggtgggcggaattcgtggtgtagcggtgaaatgcttagatatcacgaagaactccgattgcgaagg<br>cagctcactggactgcaactgacactgatgctcgaaagtgtgggtatcaaacaggattagataccctggtagtccacacagtaa<br>acgatgaatactcgctgtttgcgatatacagtaagcggccaagcgaaagcattaagtattccacctggggagtacgccggcaa<br>cggtgaaactcaaaggaattgacgggggcccgcacaagcggaggaacatgtggtttaattcgatgatacgcgaggaacctta<br>cccgggcttaaattgcatttgaatatattggaaacagtatagccgtaaggcaaatgtgaaggtgctgcatggttgtcgtcagctcg<br>tgccgtgaggtgtcggcttaagtgccataacgagcgcaacccttatctttagttactaacaggtcatgctgaggactctagagag<br>actgccgtcgtaagatgtgaggaaggtggggatgacgtcaaatcagcacggcccttacgtccggggctacacacgtgttaca<br>atggggggtacagaaggcagctacctggtgacaggatgctaatcccaaaagcctctctcagttcggatcgaagtctgcaaccc<br>gacttcgtgaagctggattcgctagtaatcgcgcatcagccatggcgcggtgaatacgttcccgggccttgtacacaccgccc<br>gtcaagccatgaaagccgggggtacctgaagtacgtaaccgcaaggagcgtcctagggtaaaactggtaattggggctaagt<br>cgtaacaaggtagccgtaccggaaggtgcggctggaacacctcctt |

TABLE 5-continued

| Full length 16S rDNA sequences of species (negative correlates) | | |
|---|---|---|
| Species Name | Sequence Identifier | 16S rDNA sequence |
| *Bacteroides _thetaiotao micron* | SEQ ID NO: 241 | atgaagagtttgatcctggctcaggatgaacgctagctacaggcttaacacatgcaagtcgaggggcagcatttcagtttgcttg<br>caaactggagatggcgaccggcgcacgggtgagtaacacgtatccaacctgccgataactcggggatagcctttcgaaagaa<br>agattaatacccgatagtataattagaccgcatggtcttattattaaagaatttcggttatcgatggggatgcgttccattaggcagt<br>tggtgaggtaacggctcaccaaaccttcgatggatagggttctgagaggaaggtcccccacattggaactgagacacggtc<br>caaactcctacgggaggcagcagtgaggaatattggtcaatggacgagagtctgaaccagccaagtagcgtgaaggatgact<br>gccctatgggttgtaaacttcttttatatgggaataaagttttccacgtgtggaattttgtatgtaccatatgaataaggatcggctaa<br>ctccgtgccagcagccgcggtaatacggaggatccgagcgttatccggatttattgggtttaaagggagcgtaggtggacagt<br>taagtcagttgtgaaagtttgcggctcaaccgtaaaattgcagttgatactggctgtcttgagtacagtagaggtgggcggaattc<br>gtggtgtagcggtgaaatgcttagatatcacgaagaactccgattgcgaaggcagctcactggactgcaactgacactgatgct<br>cgaaagtgtgggtatcaaacaggattagataccctggtagtccacacagtaaacgatgaatactcgctgtttgcgatatacagta<br>agcggccaagcgaaagcattaagtattccacctggggagtacgccggcaacggtgaaactcaaaggaattgacgggggcc<br>cgcacaagcggaggaacatgtggtttaattcgatgatacgcgaggaaccttacccgggcttaaattgcatttgaatatattggaa<br>acagtatagccgtaaggcaaatgtgaaggtgctgcatggttgtcgtcagctcgtgccgtgaggtgtcggcttaagtgccataac<br>gagcgcaacccttatctttagttactaacaggtcatgctgaggactctagagagactgccgtcgtaagatgtgaggaaggtggg<br>gatgacgtcaaatcagcacggcccttacgtccggggctacacacgtgttacaatgggggtacagaaggcagctacctggtg<br>acaggatgctaatcccaaaagcctctctcagttcggatcgaagtctgcaacccgacttcgtgaagctggattcgctagtaatcgc<br>gcatcagccatggcgcggtgaatacgttcccgggccttgtacacaccgcccgtcaagccatgaaagccgggggtacctgaa<br>gtacgtaaccgcaaggagcgtcctagggtaaaactggtaattggggctaagtcgtaacaaggtagccgtaccggaaggtgcg<br>gctggaacacctcctt |
| *Bacteroides _thetaiotao micron* | SEQ ID NO: 242 | atgaagagtttgatcctggctcaggatgaacgctagctacaggcttaacacatgcaagtcgaggggcagcatttcagtttgcttg<br>caaactggagatggcgaccggcgcacgggtgagtaacacgtatccaacctgccgataactcggggatagcctttcgaaagaa<br>agattaatacccgatggtataattagaccgcatggtcttgttattaaagaatttcggttatcgatggggatgcgttccattaggcagt<br>tggtgaggtaacggctcaccaaaccttcgatggatagggttctgagaggaaggtcccccacattggaactgagacacggtc<br>caaactcctacgggaggcagcagtgaggaatattggtcaatgggcgcaggcctgaaccagccaagtagcgtgaaggatgac<br>tgccctatgggttgtaaacttcttttatatgggaataaagttttccacgtgtggattttagtatgtaccatatgaataaggatcggcta<br>actccgtgccagcagccgcggtaatacggaggatccgagcgttatccggatttattgggtttaaagggagcgtaggtggacag<br>ttaagtcagttgtgaaagtttgcggctcaaccgtaaaattgcagttgatactggctgtcttgagtacagtagaggtgggcggaatt<br>cgtggtgtagcggtgaaatgcttagatatcacgaagaactccgattgcgaaggcagctcactggactgcaactgacactgatg<br>ctcgaaagtgtgggtatcaaacaggattagataccctggtagtccacacagtaaacgatgaatactcgctgtttgcgatatacag<br>taagcggccaagcgaaagcattaagtattccacctggggagtacgccggcaacggtgaaactcaaaggaattgacgggggc<br>ccgcacaagcggaggaacatgtggtttaattcgatgatacgcgaggaaccttacccgggcttaaattgcatttgaatatattgga<br>aacagtatagccgtaaggcaaatgtgaaggtgctgcatggttgtcgtcagacgtgccgtgaggtgtcggcttaagtgccataa<br>cgagcgcaacccttatctttagttactaacaggtcatgctgaggactctagagagactgccgtcgtaagatgtgaggaaggtgg<br>ggatgacgtcaaatcagcacggcccttacgtccggggctacacacgtgttacaatgggggtacagaaggcagctacctggt<br>gacaggatgctaatcccaaaagcctctctcagttcggatcgaagtctgcaacccgacttcgtgaagaggattcgctagtaatcg<br>cgcatcagccatggcgcggtgaatacgttcccgggccttgtacacaccgcccgtcaagccatgaaagccgggggtacctgaa<br>gtacgtaaccgcaaggagcgtectagggtaaaactggtaattggggctaagtcgtaacaaggtagccgtaccggaaggtgcg<br>gctggaacacctcctt |
| *Sutterella_w adsworthens is* | SEQ ID NO: 243 | taaagagtttgatcctggctcagattgaacgctggcggcatgctttacacatgcaagtcgaacggcagcgcggggagcttgct<br>ccctggcggcgagtggcgcacgggtgagtaatacatcggaacgtgtcttctagtgggggataactgcccgaaagggcagct<br>aataccgcatgagacctgagggtgaaagcgggggatcgcaagacctcgcgctggaagagcggccgatgtccgattagcta<br>gttggtgaggtaaaggctcaccaaggcgacgatcggtagctggtctgagaggacgaccagccacactgggactgagacac<br>ggcccagactcctacgggaggcagcagtggggaattttggacaatgggggcaaccctgatccagccatgccgcgtgcagg<br>atgaaggtcttcggattgtaaactgcttttgtcagggacgaaaagggatgcgataacaccgtattccgctgacggtacctgaag<br>aataagcaccggctaactacgtgccagcagccgcggtaatacgtagggtgcaagcgttaatcggaattactgggcgtaaagc |

TABLE 5-continued

Full length 16S rDNA sequences of species (negative correlates)

| Species Name | Sequence Identifier | 16S rDNA sequence |
| --- | --- | --- |
| | | gtgcgcaggcggttctgtaagatagatgtgaaatccccgggctcaacctgggaattgcatatatgactgcaggacttgagtttgt<br>cagaggagggtggaattccacgtgtagcagtgaaatgcgtagatatgtggaagaacaccgatggcgaaggcagccctctgg<br>ggcatgactgacgctcatgcacgaaagcgtggggagcaaacaggattagataccctggtagtccacgccctaaacgatgtct<br>actagttgttggggacgatagtccttggtaacgcagctaacgcgtgaagtagaccgcctggggagtacggtcgcaagattaaa<br>actcaaaggaattgacggggacccgcacaagcggtggatgatgtggattaattcgatgcaacgcgaaaaaccttacctagcct<br>tgacatgccaggaaggtctgagagatcagaccgtgcccgcaagggaatctggacacaggtgctgcatggctgtcgtcagctc<br>gtgtcgtgagatgttgggttaagtcccgcaacgagcgcaacccttgtcattagagctacgaaagggcactctaatgagactgc<br>cggtgacaaaccggaggaaggtggggatgacgtcaagtcctcatggcccttatggctagggcctcacacgtcatacaatggt<br>cggaacagagggaagcgaagccgcgaggtgaagccaatcccagaaaaccgatcgtagtccggattgcagtctgcaactcg<br>actgcatgaagtcggaatcgctagtaatcgcggatcagcatgccgcggtgaatacgttcccgggtcttgtacacaccgcccgt<br>cacaccatgggagtggggttcaccagaagacgtttgcccaaccgaaaggaaggcggcgtccacggtgggcttcatgactgg<br>ggtgaagtcgtaacaaggtagccgtaccggaaggtgcggctggatcacctccttt |
| *Sutterella_wadsworthensis* | SEQ ID NO: 244 | taaagagtttgatcctggctcagattgaacgctggcggcatgctttacacatgcaagtcgaacggcagcgcggggagcttgct<br>ccctggcggcgagtggcgcacgggtgagtaatacatcggaacgtgtcttctagtgggggataactgeccgaaagggcagct<br>aataccgcatgagacctgagggtgaaagcgggggatcgcaagacctcgcgctggaagagcggccgatgtccgattagcta<br>gttggtgaggtaaaggctcaccaaggcgacgatcggtagctggtctgagaggacgaccagccacactgggactgagacac<br>ggcccagactcctacgggaggcagcagtggggaattttggacaatgggggcaaccctgatccagccatgccgcgtgcagg<br>atgaaggtcttcggattgtaaactgcttttgtcagggacgaaaagggatgcgataacaccgtattccgctgacggtacctgaag<br>aataagcaccggctaactacgtgccagcagecgcggtaatacgtagggtgcaagcgttaatcggaattactgggcgtaaagc<br>gtgcgcaggcggttctgtaagatagatgtgaaatccccgggctcaacctgggaattgcatatatgactgcaggacttgagtttgt<br>cagaggagggtggaattccacgtgtagcagtgaaatgcgtagatatgtggaagaacaccgatggcgaaggcagccctctgg<br>gacatgactgacgctcatgcacgaaagcgtggggagcaaacaggattagataccctggtagtccacgccctaaacgatgtcta<br>ctagttgttggggacgatagtccttggtaacgcagctaacgcgtgaagtagaccgcctggggagtacggtcgcaagattaaaa<br>ctcaaaggaattgacgggn |
| *Sutterella_wadsworthensis* | SEQ ID NO: 245 | taaagagtttgatcctggctcagattgaacgctggcggctttgctttacacatgcaagtcgaacggcagcgcggggagcttgct<br>ccctggcggcgagtggcgcacgggtgagtaatacatcggaacgtgtcttctagtgggggataactgtccgaaagggcagcta<br>ataccgcatgagacctgagggtgaaagcgggggatcgcaagacctcgcgctggaagagcggccgatgtccgattagctagt<br>tggtgaggtaaaggctcaccaaggcgacgatcggtagctggtctgagaggacgaccagccacactgggactgagacacgg<br>cccagactcctacgggaggcagcagtggggaattttggacaatgggggcaaccctgatccagccatgccgcgtgcaggatg<br>aaggtcttcggattgtaaactgcttttgtcagggacgaaaagggatgcgataacaccgtattccgctgacggtacctgaagaata<br>agcaccggctaactacgtgccagcagccgcggtaatacgtagggtgcaagcgttaatcggaattactgggcgtaaagcgtgc<br>gcaggcggttctgtaagatagatgtgaaatccccgggctcaacctgggaattgcatatatgactgcaggacttgagtttgtcaga<br>ggagggtggaattccacgtgtagcagtgaaatgcgtagatatgtggaagaacaccgatggcgaaggcagccctctgggacat<br>gactgacgctcatgcacgaaagcgtggggagcaaacaggattagataccctggtagtccacgccctaaacgatgtctactagt<br>tgttggggacgatagtccttggtaacgcagctaacgcgtgaagtagaccgcctggggagtacggtcgcaagattaaaactcaa<br>aggaattgacggggacccgcacaagcggtggatgatgtggattaattcgatgcaacgcgaaaacccttccctagecttgacat<br>gccaggaaggtctgagagatcagaccgtgcccgcaagggaatctggacacaggtgctgcatggctgtcgtcagctcgtgtcg<br>tgagatgttgggttaagtcccgcaacgagcgcaacccttgtcattagttgctacgaaagggcactctaatgagactgccggtga<br>caaaccggaggaaggtggggatgacgtcaagtcctcatggcccttatggctagggcctcacacgtcatacaatggtcggaac<br>agagggaagcgaagccgcgaggtgaagccaatcccagaaaaccgatcgtagtccggattgcagtctgcaactcgactgcat<br>gaagtcggaatcgctagtaatcgcggatcagcatgccgcggtgaatacgacccgggtcttgtacacaccgcccgtcacacca<br>tgggagtggggttcaccagaagacgtttgcccaaccgaaaggaaggcggcgtccacggtgggcttcatgactggggtgaag<br>tcgtaacaaggtagccgtaccggaaggtgcggctggatcacctccttt |

TABLE 5-continued

| Full length 16S rDNA sequences of species (negative correlates) | | |
|---|---|---|
| Species Name | Sequence Identifier | 16S rDNA sequence |
| *Sutterella_wadsworthensis* | SEQ ID NO: 246 | taaagagtttgatcctggctcagattgaacgctggcggcatgctttacacatgcaagtcgaacggcagcgcggggagcttgct<br>ccctggcggcgagtggcgcacgggtgagtaatacatcggaacgtgtcttctagtgggggataactgcccgaaagggcagct<br>aataccgcatgagacctgagggtgaaagcggggatcgcaagacctcgcgctggaagagcggccgatgtccgattagcta<br>gttggtgaggtaaaggctcaccaaggcgacgatcggtagctggtctgagaggacgaccagccacactgggactgagacac<br>ggcccagactcctacgggaggcagcagtggggaattttggacaatgggggcaaccctgatccagccatgccgcgtgcagg<br>atgaaggtcttcggattgtaaactgcttttgtcagggacgaaaagggatgcgataacaccgtattccgctgacggtacctgaag<br>aataagcaccggctaactacgtgccagcagecgcggtaatacgtagggtgcaagcgttaatcggaattactgggcgtaaagc<br>gtgcgcaggcggttctgtaagatagatgtgaaatccccgggctcaacctgggaattgcatatatgactgcaggacttgagtttgt<br>cagaggagggtggaattccacgtgtagcagtgaaatgcgtagatatgtggaagaacaccgatggcgaaggcagccctctgg<br>gacatgactgacgctcatgcacgaaagcgtggggagcaaacaggattagataccctggtagtccacgccctaaacgatgtcta<br>ctagttgttggggacgatagtccttggtaacgcagctaacgcgtgaagtagaccgcctggggagtacggtcgcaagattaaaa<br>ctcaaaggaattgacggggacccgcacaagcggtggatgatgtggattaattcgatgcaacgcgaaaaaccttacctagcctt<br>gacatgccaggaaggcctgagagatcaggccgtgcccgcaagggaatctggacacaggtgctgcatggctgtcgtcagctc<br>gtgtcgtgagatgttgggttaagtcccgcaacgagcgcaacccttgtcattagttgctacgaaagggcactctaatgagactgc<br>cggtgacaaaccggaggaaggtggggatgacgtcaagtcctcatggcccttatggctagggcctcacacgtcatacaatggt<br>cggaacagagggaagcgaagccgcgaggtgaagccaatcccagaaaaccgatcgtagtccggattgcagtctgcaactcg<br>actgcatgaagtcggaatcgctagtaatcgcggatcagcatgccgcggtgaatacgttcccgggtcttgtacacaccgcccgt<br>cacaccatgggagtggggttcaccagaagacgtttgcccaaccgaaaggaaggcggcgtccacggtgggcttcatgactgg<br>ggtgaagtcgtaacaaggtagccgtaccggaaggtgcggctggatcacctccttt |
| *Clostridium_sp_KLE_1755* | SEQ ID NO: 247 | agagagtttgatcctggctcaggatgaacgctggcggcgtgcctaacacatgcaagtcgaacggagttatgcagaggaagttt<br>tcggatggaatcggcgtaacttagtggcggacgggtgagtaacgcgtgggaaacctgccctgtaccgggggataacacttag<br>aaataggtgctaataccgcataagcgcacagcttcacatgaggcagtgtgaaaaactccggtggtacaggatggtcccgcgtc<br>tgattagccagttggcagggtaacggcctaccaaagcgacgatcagtagccggcctgagagggtgaacggccacattggga<br>ctgagacacggcccaaactcctacgggaggcagcagtggggaatattgcacaatgggggaaaccctgatgcagcgacgcc<br>gcgtgagtgaagaagtatttcggtatgtaaagctctatcagcagggaagaaaatgacggtacctgactaagaagccccggcta<br>actacgtgccagcagccgcggtaatacgtagggggcaagcgttatccggatttactgggtgtaaagggagcgtagacggcat<br>gacaagccagatgtgaaaacccagggctcaaccctgggactgcatttggaactgccaggctggagtgcaggagaggtaagc<br>ggaattcctagtgtagcggtgaaatgcgtagatattaggaggaacaccagtggcgaaggcggcttactggactgtaactgacg<br>ttgaggctcgaaagcgtggggagcaaacaggattagataccctggtagtccacgcggtaaacgatgattgctaggtgtaggtg<br>ggtatggacccatcggtgccgcagctaacgcaataagcaatccacctggggagtacgttcgcaagaatgaaactcaaaggaa<br>ttgacggggacccgcacaagcggtggagcatgtggtttaattcgaagcaacgcgaagaaccttaccaagtcttgacatcccaa<br>tgacgtgcccgtaacggggcattctatcggagcattggagacaggtggtgcatggttgtcgtcagctcgtgtcgtgagatgttg<br>ggttaagtcccgcaacgagcgcaacccttatccttagtagccagcaggtaaagctgggcactctagggagactgccggggat<br>aacccggaggaaggcggggatgacgtcaaatcatcatgccccttatgatttgggctacacacgtgctacaatggcgtaaacaa<br>agggaagcgagacagtgatgttgagcaaatcccagaaataacgtctcagttcggattgtagtctgcaactcgactacatgaagc<br>tggaatcgctagtaatcgcgaatcagcatgtcgcggtgaatacgttcccgggtcttgtacacaccgcccgtcacaccatggga<br>gttggaaatgcccgaagcctgtgacctaaccgtaaggaaggagcagtcgaaggcaggtctaataactggggtgaagtcgtaa<br>caaggtagccgtatcggaaggtgcggctggatcacctccttt |
| *Clostridium_symbiosum* | SEQ ID NO: 248 | atgagagtttgatcctggctcaggatgaacgctggcggcgtgcctaacacatgcaagtcgaacgaagcgatttaacggaagttt<br>tcggatggaagttgaattgactgagtggcggacgggtgagtaacgcgtgggtaacctgccttgtactgggggacaacagttag<br>aaatgactgctaataccgcataagcgcacagtattgcatgatacagtgtgaaaaactccggtggtacaagatggacccgcgtct<br>gattagctagttggtaaggtaacggcttaccaaggcgacgatcagtagccgacctgagagggtgaccggccacattgggact<br>gagacacggcccaaactcctacgggaggcagcagtggggaatattgcacaatgggcgaaagcctgatgcagcgacgccgc<br>gtgagtgaagaagtatttcggtatgtaaagctctatcagcagggaagaaaatgacggtacctgactaagaagccccggctaac<br>tacgtgccagcagccgcggtaatacgtagggggcaagcgttatccggatttactgggtgtaaagggagcgtagacggtaaag |

TABLE 5-continued

| Full length 16S rDNA sequences of species (negative correlates) | | |
|---|---|---|
| Species Name | Sequence Identifier | 16S rDNA sequence |
| | | caagtctgaagtgaaagcccgcggctcaactgcgggactgctttggaaactgtttaactggagtgtcggagaggtaagtggaa<br>ttcctagtgtagcggtgaaatgcgtagatattaggaggaacaccagtggcgaaggcgacttactggacgataactgacgttga<br>ggctcgaaagcgtggggagcaaacaggattagataccctggtagtccacgccgtaaacgatgaatactaggtgttggggagc<br>aaagctcttcggtgccgtcgcaaacgcagtaagtattccacctggggagtacgttcgcaagaatgaaactcaaaggaattgac<br>ggggacccgcacaagcggtggagcatgtggtttaattcgaagcaacgcgaagaaccttaccaggtcttgacatcgatccgac<br>gggggagtaacgtccccttcccttcggggcggagaagacaggtggtgcatggttgtcgtcagctcgtgtcgtgagatgttggg<br>ttaagtcccgcaacgagcgcaacccttattctaagtagccagcggttcggccgggaactcttgggagactgccagggataacc<br>tggaggaaggtggggatgacgtcaaatcatcatgccccttatgatctgggctacacacgtgctacaatggcgtaaacaaagag<br>aagcaagaccgcgaggtggagcaaatctcaaaaataacgtctcagttcggactgcaggctgcaactcgcctgcacgaagctg<br>gaatcgctagtaatcgcgaatcagaatgtcgcggtgaatacgttcccgggtcttgtacacaccgcccgtcacaccatgggagtc<br>agtaacgcccgaagtcagtgacccaaccgcaaggagggagctgccgaaggcgggaccgataactggggtgaagtcgtaa<br>caaggtagccgtatcggaaggtgcggctggatcacctccttt |
| *Eubacterium _ramulus* | SEQ ID NO: 249 | gttctgtgactgagtggcggacgggtgagtaacgcgtggataacctgcctcacacagggggataacagttggaaacgactgc<br>taataccgcataagcgcacagcaccgcatggtgcagtgtgaaaaactccggtggtgtgagatggatccgcgtctgattagcttg<br>ttggcggggtaacggcccaccaaggcgacgatcagtagccggcctgagagggcgaccggccacattgggactgagacac<br>ggcccagactcctacgggaggcagcagtggggaatattgcacaatgggggaaaccctgatgcagcgacgccgcgtgagcg<br>atgaagtatttcggtatgtaaagctctatcagcagggaagataatgacggtacctgactaagaagctccggctaaatacgtgcc<br>agcagccgcggtaatacgtatggagcaagcgttatccggatttactgggtgtaaagggagcgtaggcggtcctgcaagtctga<br>tgtgaaaggccggggctcaaccccgggactgcattggaaactgtaggactagagtgtcggaggggtaagtggaattcctagt<br>gtagcggtgaaatgcgtagatattaggaggaacaccagtggcgaaggcggcttactggacgactactgacgctgaggctcga<br>aagcgtggggagcaaacaggattagataccctggtagtccacgccgtaaacgatgaatactaggtgttggcaggtaagacct<br>gtcggtgccgcagcaaacgcaataagtattccacctggggagtacgttcgcaagaatgaaactcaaaggaattgacggggac<br>ccgcacaagcggtggagcatgtggtttaattcgaagcaacgcgaagaaccttaccaagtcttgacatcccggtgacagaacat<br>gtaatgtgttttcccttcggggcaccggtgacaggtggtgcatggttgtcgtcagctcgtgtcgtgagatgttgggttaagtcccg<br>caacgagcgcaacccttatccccagtagccagcatttcggatgggcactctgtggagactgccagggacaacctggaggaag<br>gtggggatgacgtcaaatcatcatgccccttatgacttgggctacacacgtgctacaatggcgtaaacaaagggaagcgagac<br>cgcgaggtggagcaaatcccaaaaataacgtcccagttcggattgtagtctgcaactcgactacatgaagctggaatcgctagt<br>aatcgcagatcagaatgctgcggtgaatacgttcccgggtcttgtacacaccgcccgtcacaccatgggagtcggaaatgccc<br>gaagccggtggcctaaccgcaaggaaggagccgtcgaaggcaggtctgataactggggtgaagtcgtaacaaggtagccg<br>tatcggaaggtgcggctggatcacctccttt |
| *Ruminococc us_gnavus* | SEQ ID NO: 250 | aacgagagtttgatcctggctcaggatgaacgctggcggcgtgcttaacacatgcaagtcgagcgaagcacttttgcggatttc<br>ttcggattgaagcaattgtgactgagcggcggacgggtgagtaacgcgtgggtaacctgcctcatacagggggataacagttg<br>gaaacggctgctaataccgcataagcgcacagtaccgcatggtaccgtgtgaaaaactccggtggtatgagatggacccgcg<br>tctgattagctagttggtggggtaacggcctaccaaggcgacgatcagtagccgacctgagagggtgaccggccacattggg<br>actgagacacggcccaaactcctacgggaggcagcagtggggaatattgcacaatgggggaaaccctgatgcagcgacgc<br>cgcgtgagcgatgaagtatttcggtatgtaaagctctatcagcagggaagaaaatgacggtacctgactaagaagccccggct<br>aactacgtgccagcagccgcggtaatacgtagggggcaagcgttatccggatttactgggtgtaaagggagcgtagacggca<br>tggcaagccagatgtgaaagcccggggctcaaccccgggactgcatttggaactgtcaggctagagtgtcggagaggaaag<br>cggaattcctagtgtagcggtgaaatgcgtagatattaggaggaacaccagtggcgaaggcggctttctggacgatgactgac<br>gttgaggctcgaaagcgtggggagcaaacaggattagataccctggtagtccacgccgtaaacgatgaatactaggtgtcgg<br>gtggcaaagccattcggtgccgcagcaaacgcaataagtattccacctggggagtacgttcgcaagaatgaaactcaaagga<br>attgacggggacccgcacaagcggtggagcatgtggtttaattcgaagcaacgcgaagaaccttacctggtcttgacatcccc<br>ctgaccgctctttaatcggagctttccttcgggacaggggagacaggtggtgcatggttgtcgtcagctcgtgtcgtgagatgtt<br>gggttaagtcccgcaacgagcgcaacccctatctttagtagccagcatttcggatgggcactctagagagactgccagggata<br>acctggaggaaggtggggatgacgtcaaatcatcatgccccttatgaccagggctacacacgtgctacaatggcgtaaacaaa<br>gggaagcgagcccgcgagggggagcaaatcccaaaaataacgtctcagttcggattgtagtctgcaactcgactacatgaag |

TABLE 5-continued

| Full length 16S rDNA sequences of species (negative correlates) | | |
|---|---|---|
| Species Name | Sequence Identifier | 16S rDNA sequence |
| | | ctggaatcgctagtaatcgcgaatcagaatgtcgcggtgaatacgttcccgggtcttgtacacaccgcccgtcacaccatggga<br>gtcagtaacgcccgaagtcagtgacccaaccgcaaggagggagctgccgaaggtgggaccgataactggggtgaagtcgt<br>aacaaggtagccgtatcggaaggtgcggctggatcacctccttt |
| *Ruminococc us_gnavus* | SEQ ID NO: 251 | aacgagagtttgatcctggctcaggatgaacgctggcggcgtgcttaacacatgcaagtcgagcgaagcaccttgacggattt<br>cttcggattgaagccttggtgactgagcggcggacgggtgagtaacgcgtgggtaacctgcctcatacagggggataacagtt<br>ggaaacggctgctaataccgcataagcgcacagtaccgcatggtacggtgtgaaaaactccggtggtatgagatggacccgc<br>gtctgattaggtagttggtggggtaacggcctaccaagccgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgatgaagtatttcggtatgtaaagctctatcagcagggaagaaaatgacggtacctgactaagaagccccggc<br>taactacgtgccagcagccgcggtaatacgtagggggcaagcgttatccggatttactgggtgtaaagggagcgtagacggc<br>atggcaagccagatgtgaaagcccggggctcaaccccgggactgcatttggaactgtcaggctagagtgtcggagaggaaa<br>gcggaattcctagtgtagcggtgaaatgcgtagatattaggaggaacaccagtggcgaaggcggctttctggacgatgactga<br>cgttgaggctcgaaagcgtggggagcaaacaggattagataccctggtagtccacgccgtaaacgatgaatactaggtgtcg<br>ggtggcaaagccattcggtgccgcagcaaacgcaataagtattccacctggggagtacgttcgcaagaatgaaactcaaagg<br>aattgacggggacccgcacaagcggtggagcatgtggtttaattcgaagcaacgcgaagaaccttacctggtcttgacatccc<br>tctgaccgctctttaatcggagctttccttcgggacagaggagacaggtggtgcatggttgtcgtcagctcgtgtcgtgagatgtt<br>gggttaagtcccgcaacgagcgcaacccctatctttagtagccagcattttggatgggcactctagagagactgccagggata<br>acctggaggaaggtggggatgacgtcaaatcatcatgccccttatgatcagggctacacacgtgctacaatggcgtaaacaaa<br>gggaagcgagcccgcgagggggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gtcagtaacgcccgaagtcagtgacccaaccgcaaggagggagctgccgaaggtgggaccgataactggggtgaagtcgt<br>aacaaggtagccgtatcggaaggtgcggctggatcacctccttt |
| *Ruminococc us_gnavus* | SEQ ID NO: 252 | aacgagagtttgatcctggctcaggatgaacgctggcggcgtgcttaacacatgcaagtcgagcgaagcaccttgacggattt<br>cttcggattgaagccttggtgactgagcggcggacgggtgagtaacgcgtgggtaacctgcctcatacagggggataacagtt<br>ggaaacggctgctaataccgcataagcgcacagtaccgcatggtacggtgtgaaaaactccggtggtatgagatggacccgc<br>gtctgattaggtagttggtggggtaacggcctaccaagccgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgatgaagtatttcggtatgtaaagctctatcagcagggaagaaaatgacggtacctgactaagaagccccggc<br>taactacgtgccagcagccgcggtaatacgtagggggcaagcgttatccggatttactgggtgtaaagggagcgtagacggc<br>atggcaagccagatgtgaaagcccggggctcaaccccgggactgcatttggaactgtcaggctagagtgtcggagaggaaa<br>gcggaattcctagtgtagcggtgaaatgcgtagatattaggaggaacaccagtggcgaaggcggctttctggacgatgactga<br>cgttgaggctcgaaagcgtggggagcaaacaggattagataccctggtagtccacgccgtaaacgatgaatactaggtgtcg<br>ggtggcaaagccattcggtgccgcagcaaacgcaataagtattccacctggggagtacgttcgcaagaatgaaactcaaagg<br>aattgacggggacccgcacaagcggtggagcatgtggtttaattcgaagcaacgcgaagaaccttacctggtcttgacatccc<br>cctgaccgctctttaatcggagctttccttcgggacagaggagacaggtggtgcatggttgtcgtcagctcgtgtcgtgagatgt<br>tgggttaagtcccgcaacgagcgcaacccctatctttagtagccagcattttggatgggcactctagagagactgccagggata<br>acctggaggaaggtggggatgacgtcaaatcatcatgccccttatgatcagggctacacacgtgctacaatggcgtaaacaaa<br>gggaagcgagcccgcgagggggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gtcagtaacgcccgaagtcagtgacccaaccgcaaggagggagctgccgaaggtgggaccgataactggggtgaagtcgt<br>aacaaggtagccgtatcggaaggtgcggctggatcacctccttt |
| *Ruminococc us_gnavus* | SEQ ID NO: 253 | ncgacgatcagtagccgacctgagagggtgaccggccacattgggactgagacacggcccaaactcctacgggaggcagc<br>agtggggaatattgcacaatgggggaaaccctgatgcagcgacgccgcgtgagcgatgaagtatttcggtatgtaaagctcta<br>tcagcagggaagaaaatgacggtacctgactaagaagccccggctaactacgtgccagcagccgcggtaatacgtagggg<br>gcaagcgttatccggatttactgggtgtaaagggagcgtagacggcatggcaagccagatgtgaaagcccggggctcaacc |

TABLE 5-continued

| Species Name | Sequence Identifier | 16S rDNA sequence |
|---|---|---|
| Full length 16S rDNA sequences of species (negative correlates) | | |
| | | ccgggactgcatttggaactgtcaggctagagtgtcggagaggaaagcggaattcctagtgtagcggtgaaatgcgtagatat<br>taggaggaacaccagtggcgaaggcggctttctggacgatgactgacgttgaggctcgaaagcgtggggagcaaacaggat<br>tagataccctggtagtccacgccgtaaacgatgaatactaggtgtcgggtggcaaagccattcggtgccgcagcaaacgcaat<br>aagtattccacctggggagtacgttcgcaagaatgaaactcaaaggaattgacggggacccgcacaagcggtggagcatgtg<br>gtttaattcgaagcaacgcgaagaaccttacctggtcttgacatccctctgaccgctctttaatcggaactttccttcgggacaga<br>ggagacaggtggtgcatggttgtcgtcagctcgtgtcgtgagatgttgggttaagtcccgcaacgagcgcaacccctatcttta<br>gtagccagcatttggatgggcactctagagagactgccagggataacctggaggaaggtggggatgacgtcaaatcatcat<br>gccccttatgaccagggctacacacgtgctacaatggcgtaaacaaagggaagcgagcccgcgaggggggagcaaatccca<br>aaaataacgtctcagttcggattgtagtctgcaactcgactacatgaagctggaatcgctagtaatcgcgaatcagaatgtcgcg<br>gtgaatacgttcccgggtcttgtacacaccgcccgtcacaccatgggagtcagtaacgcccgaagtcagtgacccaaccgca<br>aggagggagctgccgaaggtgggaccgataactggggtgaagtcgtaacaaggtagccgtatcggaaggtgcggctggat<br>cacctccttt |
| *Ruminococc us_gnavus* | SEQ ID NO: 254 | aacgagagtttgatcctggctcaggatgaacgctggcggcgtgcttaacacatgcaagtcgagcgaagcaccttgacggattt<br>cttcggattgaagccttggtgactgagcggcggacgggtgagtaacgcgtgggtaacctgcctcatacagggggataacagtt<br>ggaaacggctgctaataccgcataagcgcacagtaccgcatggtacggtgtgaaaaactccggtggtatgagatggacccgc<br>gtctgattaggtagttggtggggtaacggcctaccaagccgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgatgaagtatttcggtatgtaaagctctatcagcagggaagaaaatgacggtacctgactaagaagccccggc<br>taactacgtgccagcagccgcggtaatacgtagggggcaagcgttatccggatttactgggtgtaaagggagcgtagacggc<br>atggcaagccagatgtgaaagcccggggctcaaccccgggactgcatttggaactgtcaggctagagtgtcggagaggaaa<br>gcggaattcctagtgtagcggtgaaatgcgtagatattaggaggaacaccagtggcgaaggcggctttctggacgatgactga<br>cgttgaggctcgaaagcgtggggagcaaacaggattagataccctggtagtccacgccgtaaacgatgaatactaggtgtcg<br>ggtggcaaagccattcggtgccgcagcaaacgcaataagtattccacctggggagtacgttcgcaagaatgaaactcaaagg<br>aattgacggggacccgcacaagcggtggagcatgtggtttaattcgaagcaacgcgaagaaccttacctggtcttgacatccc<br>tctgaccgctctttaatcggagctttccttcgggacagaggagacaggtggtgcatggttgtcgtcagctcgtgtcgtgagatgtt<br>gggttaagtcccgcaacgagcgcaacccctatctttagtagccagcatttcggatgggcactctagagagactgccagggata<br>acctggaggaaggtggggatgacgtcaaatcatcatgccccttatgaccagggctacacacgtgctacaatggcgtaaacaaa<br>gggaagcgagcccgcgaggggggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gtcagtaacgcccgaagtcagtgacccaaccgcaaggagggagctgccgaaggtgggaccgataactggggtgaagtcgt<br>aacaaggtagccgtatcggaaggtgcggctggatcacctccttt |
| *Blautia_wex lerae* | SEQ ID NO: 255 | tcagagagtttgatcctggctcaggatgaacgctggcggcgtgcttaacacatgcaagtcgaacgggaaatatttcattgagac<br>ttcggtggatttgatctatttctagtggcggacgggtgagtaacgcgtgggtaacctgccttatacagggggataacagtcagaa<br>atggctgctaataccgcataagcgcacagagctgcatggctcagtgtgaaaaactccggtggtataagatggacccgcgttgg<br>attagctagttggtggggtaacggcccaccaaggcgacgatccatagccggcctgagagggtgaacggccacattgggact<br>gagacacggcccagactcctacgggaggcagcagtggggaatattgcacaatgggggaaaccctgatgcagcgacgccg<br>cgtgaaggaagaagtatctcggtatgtaaacttctatcagcagggaagatagtgacggtacctgactaagaagccccggctaa<br>ctacgtgccagcagccgcggtaatacgtagggggcaagcgttatccggatttactgggtgtaaagggagcgtagacggtgtg<br>gcaagtctgatgtgaaaggcatgggctcaacctgtggactgcattggaaactgtcatacttgagtgccggaggggtaagcgga<br>attcctagtgtagcggtgaaatgcgtagatattaggaggaacaccagtggcgaaggcggcttactggacggtaactgacgttg<br>aggctcgaaagcgtggggagcaaacaggattagataccctggtagtccacgccgtaaacgatgaatactaggtgtcgggtgg<br>cagagccattcggtgccgtcgcaaacgcagtaagtattccacctggggagtacgttcgcaagaatgaaactcaaaggaattga<br>cggggacccgcacaagcggtggagcatgtggtttaattcgaagcaacgcgaagaaccttaccaagtcttgacatccgcctga<br>ccgatccttaaccggatctttccttcgggacaggcgagacaggtggtgcatggttgtcgtcagctcgtgtcgtgagatgttgggt<br>taagtcccgcaacgagcgcaacccctatcctcagtagccagcatttaaggtgggcactctggggagactgccagggataacct<br>ggaggaaggcggggatgacgtcaaatcatcatgccccttatgatttgggctacacacgtgctacaatggcgtaaacaaaggg |

TABLE 5-continued

Full length 16S rDNA sequences of species (negative correlates)

| Species Name | Sequence Identifier | 16S rDNA sequence |
|---|---|---|
| | | aagcgagattgtgagatggagcaaatcccaaaaataacgtcccagttcggactgtagtctgcaacccgactacacgaagctgg<br>aatcgctagtaatcgcggatcagaatgccgcggtgaatacgttcccggg |
| *Gemmiger_formicilis* | SEQ ID NO: 256 | aaaggatttattcgcttcaggatggactcgcgtccaattagctagttggtgaggtaacggcccaccaaggcgacgattggtagc<br>cggactgagaggttgaacggccacattgggactgagacacggcccagactcctacgggaggcagcagtgggggatattgc<br>acaatgggggaaaccctgatgcagcgacgccgcgtggaggaagaaggttttcggattgtaaactcctgtcgttagggacgat<br>aatgacggtacctaacaagaaagcaccggctaactacgtgccagcagccgcggtaaaacgtagggtgcaagcgttgtccgg<br>aattactgggtgtaaagggagcgcaggcggaccggcaagttggaagtgaaatccatgggctcaacccgtgaattgctttcaaa<br>actgctggccttgagtagtgcagaggtaggtggaattcccggtgtagcggtggaatgcgtagatatcgggaggaacaccagt<br>ggcgaaggcgacctactgggcaccaactgacgctgaggctcgaaagcatgggtagcaaacaggattagataccctggtagt<br>ccatgccgtaaacgatgattactaggtgttggaggattgaccccttcagtgccgcagttaacacaataagtaatccacctgggg<br>agtacgaccgcaaggttgaaactcaaaggaattgacgggggcccgcacaagcagtggagtatgtggtttaattcgaagcaac<br>gcgaagaaccttaccaggtcttgacatccgatgcatagtgcagagatgcatgaagtccttcgggacatcgagacaggtggtgc<br>atggttgtcgtcagctcgtgtcgtgagatgttgggttaagtcccgcaacgagcgcaacccttattgccagttactacgcaagagg<br>actctggcgagactgccgttgacaaaacggaggaaggtggggatgacgtcaaatcatcatgccctttatgacctgggctacac<br>acgtactacaatggcgtttaacaaagagaagcaagaccgcgaggtggagcaaaactcagaaacaacgtctcagttcagattg<br>caggctgcaactcgcctgcatgaagtcggaattgctagtaatcgcggatcagcatgccgcggtgaatacgttcccgggccttgt<br>acacaccgcccgtcacaccatgagagccgggggacccgaagtcggtagtctaaccgcaaggaggacgccgccgaaggt<br>aaaactggtgattggggtgaagtcgtaacaaggtagccgtatcggaaggtgcggctggatcacctccttt |
| *Eisenbergiella_massiliensis* | SEQ ID NO: 257 | agagagtttgatcctggctcaggatgaacgctggcggcgtgcctaacacatgcaagtcgaacggagttatgcagaggaagttt<br>tcggatggaatcggcgtaacttagtggcggacgggtgagtaacgcgtgggaaacctgccctgtaccgggggataacacttag<br>aaataggtgctaataccgcataagcgcacagcttcacatgaggcagtgtgaaaaactccggtggtacaggatggtcccgcgtc<br>tgattagccagttggcagggtaacggcctaccaaagcgacgatcagtagccggcctgagagggtgaacggccacattggga<br>ctgagacacggcccaaactcctacgggaggcagcagtggggaatattgcacaatgggggaaaccctgatgcagcgacgcc<br>gcgtgagtgaagaagtatttcggtatgtaaagctctatcagcagggaagaaaatgacggtacctgactaagaagccccggcta<br>actacgtgccagcagccgcggtaatacgtagggggcaagcgttatccggatttactgggtgtaaagggagcgtagacggcat<br>gacaagccagatgtgaaaacccagggctcaaccctgggactgcatttggaactgccaggctggagtgcaggagaggtaagc<br>ggaattcctagtgtagcggtgaaatgcgtagatattaggaggaacaccagtggcgaaggcggcttactggactgtaactgacg<br>ttgaggctcgaaagcgtggggagcaaacaggattagataccctggtagtccacgcggtaaacgatgattgctaggtgtaggtg<br>ggtatggacccatcggtgccgcagctaacgcaataagcaatccacctggggagtacgttcgcaagaatgaaactcaaaggaa<br>ttgacggggacccgcacaagcggtggagcatgtggtttaattcgaagcaacgcgaagaaccttaccaagtcttgacatcccaa<br>tgacgtgtccgtaacggggcattctcttcggagcattggagacaggtggtgcatggttgtcgtcagctcgtgtcgtgagatgttg<br>ggttaagtcccgcaacgagcgcaacccttatccttagtagccagcaggtaaagctgggcactctagggagactgccggggat<br>aacccggaggaaggcggggatgacgtcaaatcatcatgccccttatgatttgggctacacacgtgctacaatggcgtaaacaa<br>agggaagcgagacagtgatgttgagcaaatcccagaaataacgtctcagttcggattgtagtctgcaactcgactacatgaagc<br>tggaatcgctagtaatcgcgaatcagcatgtcgcggtgaatacgttcccgggtcttgtacacaccgcccgtcacaccatggga<br>gttggaaatgcccgaagcctgtgacctaaccgcaagggaggagcagtcgaaggcaggtctaataactggggtgaagtcgta<br>acaaggtagccgtatcggaaggtgcggctggatg |
| *Ruminococcus_sp.* | SEQ ID NO: 258 | ctaaagagtttgatcctggctcaggacgaacgctggcggcgcgcctaacacatgcaagtcgaacggagaaatgctgagcttg<br>ctttgcatttcttagtggcggacgggtgagtaacacgtgagcaacctgcctttgtgaggggaataacgtctggaaacggacgct<br>aataccgcataacgtcaaggaaccgcatggtttttgaccaaagattttatcgcacaaagatgggctcgcggctgattagctagtt<br>ggcggggtaacggcccaccaaggcgacgatcagtagccggactgagaggttgatcggccacattgggactgagacacggc<br>ccagactcctacgggaggcagcagtgggggatattgcacaatgggggaaaccctgatgcagcgacgccgcgtgagggaa<br>gacggttttcggattgtaaacctctgtcttcagggacgaaatcaatgacggtacctgaggaggaagccacggctaactacgtgc<br>cagcagccgcggtaatacgtaggtggcaagcgttgtccggaattactgggtgtaaagggagcgtaggcgggaatgcaagttg<br>aatgtttaaactatcggctcaactgataatcgcgttcaaaactgcatttcttgagtggagtagaggcaggcggaattcctagtgta |

TABLE 5-continued

| Species Name | Sequence Identifier | 16S rDNA sequence |
|---|---|---|
| Full length 16S rDNA sequences of species (negative correlates) | | |
| | | gcggtgaaatgcgtagatattaggaggaacaccagtggcgaaggcggcctgctgggctctaactgacgctgaggctcgaaa<br>gcgtgggtagcaaacaggattagataccctggtagtccacgccgtaaacgatgattactaggtgtgggggggactgaccccttc<br>cgtgccggagttaacacaataagtaatccacctggggagtacggtcgcaagactgaaactcaaaggaattgacgggggccc<br>gcacaagcagtggagtatgtggtttaattcgaagcaacgcgaagaaccttaccaggtcttgacatcgtgcgcataccgtagag<br>atacgggaagtccttcgggacgcatagacaggtggtgcatggttgtcgtcagctcgtgtcgtgagatgttgggttaagtcccgc<br>aacgagcgcaacccttattattagttgctacgcaagagcactctaatgagactgccgttgacaaaacggaggaaggtggggat<br>gacgtcaaatcatcatgccccttatgacctgggctacacacgtactacaatggcacttaacagagggaagcaagaccgcgag<br>gtggagcaaaccccaaaaagtgtctcagttcggattgcaggctgcaacccgcctgtatgaagtcggaattgctagtaatcgc<br>ggatcagcatgccgcggtgaatacgttcccgggccttgtacacaccgcccgtcacaccatgagagccggtaacacccgaagt<br>cagtagcctaaccgcaaggagggcgctgccgaaggtgggattggtgattagggtgaagtcgtaacaaggtagccgtatcgg<br>aaggtgcggctggatcacctccttt |
| *Roseburia_faecis* | SEQ ID NO: 259 | atgagagtttgatcctggctcaggatgaacgctggcggcgtgcttaacacatgcaagtcgaacgaagcactctatttgattttctt<br>cggaaatgaagattttgtgactgagtggcggacgggtgagtaacgcgtgggtaacctgcctcatacaggggggataacagttg<br>gaaacgactgctaataccgcataagcgcacaggattgcatgatccggtgtgaaaaactccggtggtatgggatggacccgcg<br>tctgattagccagttggcagggtaacggcctaccaaagcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgagcgaagaagtatttcggtatgtaaagctctatcagcaggaaagaaaaatgacggtacctgactaagaagcaccg<br>gctaaatacgtgccagcagccgcggtaatacgtatggtgcaagcgttatccggatttactgggtgtaaagggagcgcaggcg<br>gtgcggcaagtctgatgtgaaagcccggggctcaaccccggtactgcattggaaactgtcgtactagagtgtcggaggggta<br>agtggaattcctagtgtagcggtgaaatgcgtagatattaggaggaacaccagtggcgaaggcggcttactggacgataactg<br>acgctgaggctcgaaagcgtggggagcaaacaggattagataccctggtagtccacgccgtaaacgatgaatactaggtgtc<br>ggggagcattgctcttcggtgccgcagcaaacgcaataagtattccacctggggagtacgttcgcaagaatgaaactcaaagg<br>aattgacggggacccgcacaagcggtggagcatgtggtttaattcgaagcaacgcgaagaaccttaccaagtcttgacatccc<br>gatgacagagtatgtaatgtactttctcttcggagcatcggtgacaggtggtgcatggttgtcgtcagctcgtgtcgtgagatgtt<br>gggttaagtcccgcaacgagcgcaacccctgttcttagtagccgcggttcggccgggcactctagggagactgccagggat<br>aacctggaggaaggcggggatgacgtcaaatcatcatgccccttatgacttgggctacacacgtgctacaatggcgtaaacaa<br>agggaagcggagccgtgaggccgagcaaatctcaaaaataacgtctcagttcggactgtagtctgcaacccgactacacgaa<br>gctggaatcgctagtaatcgcagatcagaatgctgcggtgaatacgttcccgggtcttgtacacaccgcccgtcacaccatgg<br>gagttggaaatgcccgaagtcagtgacccaaccgcaaggagggagctgccgaaggcaggttcgataactggggtgaagtc<br>gtaacaaggtagccgtatcggaaggtgcggctggatcacctccttt |
| *Butyrivibrio_sp.* | SEQ ID NO: 260 | ttgagagtttgatcctggctcaggatgaacgctggcggcgtgcttaacacatgcaagtcgaacggacggattggagcttgctcc<br>atgaagttagtggcggacgggtgagtaacgcgtgggtaacctgccctatgcaggggggataacgtttggaaacgaacgctaat<br>accgcataacctagttggttcgcatgaaccgactagcaaagattttatcggcataggatggacccgcgttggattagctagttgg<br>tgagataacagcccaccaaggcaacgatccatagccggcctgagagggtgaacggccacactgggactgagacacggccc<br>agactcctacgggaggcagcagtggggaatattgcacaatgggcgcaagcctgatgcagcgacgccgcgtgaaggatgaa<br>ggtcttcggatcgtaaacttctatcagcagggaagaaaccatgacggtacctgactaagaagccccggctaactacgtgccag<br>cagccgcggtaatacgtagggggcaagcgttatccggaattactgggtgtaaagggtgcgtaggcggcgatttaagtcagat<br>gtgaaaactcagggctcaaccttgagactgcatctgaaactgagttgctagagtgcaggagaggaaagcggaattccgagtgt<br>agcggtgaaatgcgtagagattcggaggaacaccagtagcgaaggcggctttctggactgtaactgacgctgaggcacgaa<br>agcgtggggagcgaacaggattagataccctggtagtccacgccgtaaacgatgaatactaggtgtcggggcttacgggtct<br>cggtgccgcagctaacgcattaagtattccacctgggaagtacgaccgcaaggttgaaactcaaaggaattgacggggaccc<br>gcacaagcggtggagcatgtggtttaattcgaagcaacgcgaagaaccttacctaaacttgacatccctttgaccggtccttaat<br>cggatctttactagcttgctagtacaaaggtgacaggtggtgcatggttgtcgtcagctcgtgtcgtgagatgttgggttaagtcc<br>cgcaacgagcgcaacccctatctttagtagccatcattcagttgggcactctagagagactgccagggataacctggaggaag<br>gtggggatgacgtcaaatcatcatgccccttatgtttagggctacacacgtgctacaatgggtgctacaaagggaagcaaatcc<br>gcgaggccgagcaaatctcaaaaaagcactcccagttcggattgtagtctgcaactcgactacatgaagttggaatcgctagta |

TABLE 5-continued

| Full length 16S rDNA sequences of species (negative correlates) | | |
|---|---|---|
| Species Name | Sequence Identifier | 16S rDNA sequence |
| | | atcgcgaatcagaatgtcgcggtgaatacgttcccgggtcttgtacacaccgcccgtcacaccatgggagttgggggggccc<br>aacgccagtgacctaacccgcaagggaaggagctgtctaaggcaaaaccaatgactggggtgaagtcgtaacaaggtagcc<br>gtatcggaaggtgcggctggatcacctccttt |
| *Blautia_sp_ CAG_257* | SEQ ID NO: 261 | acagagagtttgatcctggctcaggatgaacgctggcggcgtgcttaacacatgcaagtcgaacggggattattttgacagag<br>acttcggttgaagtcgttataatcctagtggcggacgggtgagtaacgcgtgggtaacctgcctcacactgggggataacagtc<br>agaaatgactgctaataccgcataagcgcacagagctgcatggctcagtgtgaaaaactccggtggtgtgagatggacccgc<br>gttggattagccagttggcagggtaacggcctaccaaagcgacgatccatagccggcctgagagggtggacggccacattg<br>ggactgagacacggcccagactcctacgggaggcagcagtggggaatattgcacaatgggggaaaccctgatgcagcgac<br>gccgcgtgaaggaagaagtatctcggtatgtaaacttctatcagcagggaagaaaatgacggtacctgactaagaagccccg<br>gctaactacgtgccagcagccgcggtaatacgtagggggcaagcgttatccggatttactgggtgtaaagggagcgtagacg<br>gagcagcaagtctgatgtgaaaggcgggggctcaacccccggactgcattggaaactgttgatcttgagtaccggagaggta<br>agcggaattcctagtgtagcggtgaaatgcgtagatattaggaggaacaccagtggcgaaggcggcttactggacggtaact<br>gacgttgaggctcgaaagcgtggggagcaaacaggattagataccctggtagtccacgccgtaaacgatgaatactaggtgt<br>cgggtggcagagccattcggtgccgcagcaaacgcagtaagtattccacctggggagtacgttcgcaagaatgaaactcaaa<br>ggaattgacggggacccgcacaagcggtggagcatgtggtttaattcgaagcaacgcgaagaaccttaccaagtcttgacatc<br>cctctgaccggtgagtaacgtcacctttccttcgggacagaggagacaggtggtgcatggttgtcgtcagctcgtgtcgtgaga<br>tgttgggttaagtcccgcaacgagcgcaacccctatccttagtagccagcggtttggccgggcactctgaggagactgccagg<br>gataacctggaggaaggcggggatgacgtcaaatcatcatgccccttatgatttgggctacacacgtgctacaatggcgtaaa<br>caaagggaagcgagagtgtgagcttaagcaaatcccaaaaataacgtcccagttcggactgcagtctgcaactcgactgcac<br>gaagctggaatcgctagtaatcgcggatcagaatgccgcggtgaatacgttcccgggtcttgtacacaccgcccgtcacacca<br>tgggagtcagtaacgcccgaagtcagtgaccgaaccgaaaggacggagctgccgaaggcgggacggatgactggggtga<br>agtcgtaacaaggtagccgtatcggaaggtgcggctggatcacctccttt |
| *Eubacterium _sp_3_1_31* | SEQ ID NO: 262 | gaacggccacattgggactgagacacggcccagactcctacgggaggcagcagtggggaatattgcgcaatgggggaaac<br>cctgacgcagcaacgccgcgtgattgaagaaggccttcgggttgtaaagatctttaattggggacgaaaaatgacggtaccca<br>aagaataagctccggctaactacgtgccagcagccgcggtaatacgtagggagcaagcgttatccggatttactgggtgtaaa<br>gggcgagtaggcgggctggcaagagggagtgaaatcccggggcttaaccccggaactgctttcaaaactgctggtcttgagt<br>gatggagaggcaggcggaattccgtgtgtagcggtgaaatgcgtagatatacggaggaacaccagtggcgaaggcggcct<br>gctggacattaactgacgctgaggagcgaaagcgtggggagcaaacaggattagataccctggtagtccacgccgtaaacg<br>atggatactaggtgtgggaggtattgaccccttccgtgccggagttaacacaataagtatcccacctggggagtacggccgca<br>aggttgaaactcaaaggaattgacgggggcccgcacaagcagtggagtatgtggtttaattcgaagcaacgcgaagaacctt<br>accaggtcttgacatccctctgaccgccctagagatagggtttcccttcggggcagaggtgacaggtggtgcatggttgtcgtc<br>agctcgtgtcgtgagatgttgggttaagtcccgcaacgagcgcaacccttacggttagttgatacgcaagatcactctagccgg<br>actgccgttgacaaaacggaggaaggtggggacgacgtcaaatcatcatgccccttatgacctgggctacacacgtactacaa<br>tggcagtcatacagagggaagcaaaacagtgatgtggagcaaatccctaaaagctgtcccagttcagattgcaggctgcaact<br>cgcctgcatgaagtcggaattgctagtaatcgcggatcagcatgccgcggtgaatacgttcccgggccttgtacacaccgccc<br>gtcacaccatgagagccggtaatacccgaagtccgtagcctaaccgcaaggagggcgcggccgaaggtaggactggtaatt<br>agggtgaagtcgtaacaaggtagccgtatcggaaggtgcggctggatcacctccttt |
| *Gemmiger_f ormicilis* | SEQ ID NO: 263 | aaaaggatttattcgctttaggatggactcgcgtccaattagctagttggtgaggtaacggcccaccaaggcgacgattggtag<br>ccggactgagaggttgaacggccacattgggactgagacacggcccagactcctacgggaggcagcagtgggggatattg<br>cacaatgggggaaaccctgatgcagcgacgccgcgtggaggaagaaggttttcggattgtaaactcctgtcgttagggacga<br>taatgacggtacctaacaagaaagcaccggctaactacgtgccagcagccgcggtaaaacgtagggtgcaagcgttgtccgg<br>aattactgggtgtaaagggagcgcaggcgggaagacaagttggaagtgaaaaccatgggctcaacccatgaattgctttcaa<br>aactgtttttcttgagtagtgcagaggtagatggaattcccggtgtagcggtggaatgcgtagatatcgggaggaacaccagtg<br>gcgaaggcggtctactgggcaccaactgacgctgaggctcgaaagcatgggtagcaaacaggattagataccctggtagtcc<br>atgccgtaaacgatgattactaggtgttggggggattgacccctcagtgccgcagttaacacaataagtaatccacctggggag |

TABLE 5-continued

| Full length 16S rDNA sequences of species (negative correlates) | | |
|---|---|---|
| Species Name | Sequence Identifier | 16S rDNA sequence |
| | | tacgaccgcaaggttgaaactcaaaggaattgacgggggcccgcacaagcagtggagtatgtggtttaattcgaagcaacgc gaagaaccttaccaggtcttgacatccgatgcatagcacagagatgtgtgaaatctttcgggacatcgagacaggtggtgcat ggttgtcgtcagctcgtgtcgtgagatgttgggttaagtcccgcaacgagcgcaacccttattgccagttactacgttaagagga ctctggcgagactgccgttgacaaaacggaggaaggtggggatgacgtcaaatcatcatgccctttatgacctgggctacaca cgtactacaatggcgttaaacaaagagaagcaagaccgcgaggtggagcaaaactcaaaaacaacgtctcagttcagattgc aggctgcaactcgcctgcatgaagtcggaattgctagtaatcgcggatcagcatgccgcggtgaatacgttcccgggccttgta cacaccgcccgtcacaccatgagagccgggggacccgaagtcgatagtctaaccgcaaggaggacgtcgccgaaggtaa aactggtgattggggtgaagtcgtaacaaggtagccgtatcggaaggtgcggctggatcacctccttt |
| *Intestinimonas_butyriciproducens* | SEQ ID NO: 264 | ggctcaccaaggcgacgatcagtagccggactgagaggttggccggccacattgggactgagacacggcccagactccta cgggaggcagcagtggggaatattgggcaatgggcgaaagcctgacccagcaacgccgcgtgaaggaagaaggccctcg ggttgtaaacttcttttgtcagggacgaagcaagtgacggtacctgacgaataagccacggctaactacgtgccagcagccgc ggtaatacgtaggtggcaagcgttatccggatttactgggtgtaaagggcgtgtaggcgggagtgcaagtcagatgtgaaaac tatgggctcaacccatagcctgcatttgaaactgtacttcttgagtgatggagaggcaggcggaattccctgtgtagcggtgaaa tgcgtagatatagggaggaacaccagtggcgaaggcggcctgctggacattaactgacgctgaggcgcgaaagcgtgggg agcaaacaggattagataccctggtagtccacgccgtaaacgatggatactaggtgtgggggggtctgacccccctccgtgccg cagttaacacaataagtatcccacctggggagtacgatcgcaaggttgaaactcaaaggaattgacgggggcccgcacaagc ggtggagtatgtggtttaattcgaagcaacgcgaagaaccttaccaggacttgacatcctactaacgaagcagagatgcataag gtgcccttcggggaaagtagagacaggtggtgcatgttgtcgtcagctcgtgtcgtgagatgttgggttaagtcccgcaacga gcgcaacccttattgttagttgctacgcaagagcactctagcgagactgccgttgacaaaacggaggaaggtggggacgacg tcaaatcatcatgccccttatgtcctgggccacacacgtactacaatggcggtcaacagagggaagcaaagccgcgaggtgg agcaaatccctaaaagccgtcccagttcggattgcaggctgaaactcgcctgtatgaagtcggaatcgctagtaatcgcggatc agcatgccgcggtgaatacgttcccgggccttgtacacaccgcccgtcacaccatgagagtcgggaacacccgaagtccgta gcctaacagcaatgggggcgcggccgaaggtgggttcgataattggggtgaagtcgtaacaaggtagccgtatcggaaggt gcggctggatcacctccttt |
| *Oscillospiraceae_bacterium*_VE202_24 | SEQ ID NO: 265 | tatagagagtttgatcctggctcaggacgaacgctggcggcgtgcttaacacatgcaagtcgaacggagcacccttgactgag gtttcggccaaatgataggaatgcttagtggcggactggtgagtaacgcgtgaggaacctaccttccagaggggacaacag ttggaaacgactgctaataccgcatgacgcatgaccggggcatcccgggcatgtcaaagattttatcgctggaagatggcctc gcgtctgattagctagatggtggggtaacggcccaccatggcgacgatcagtagccggactgagaggttgaccggccacatt gggactgagatacggcccagactcctacgggaggcagcagtggggaatattgggcaatggacgcaagtctgacccagcaa cgccgcgtgaaggaagaaggctttcgggttgtaaacttcttttgtcagggaagagtagaagacggtacctgacgaataagcca cggctaactacgtgccagcagccgcggtaatacgtaggtggcaagcgttgtccggatttactgggtgtaaagggcgtgcagc cgggccggcaagtcagatgtgaaatctggaggcttaacctccaaactgcatttgaaactgtaggtcttgagtaccggagaggtt atcggaattccttgtgtagcggtgaaatgcgtagatataaggaagaacaccagtggcgaaggcggataactggacggcaact gacggtgaggcgcgaaagcgtggggagcaaacaggattagataccctggtagtccacgctgtaaacgatggatactaggtgt gcggggactgacccccctgcgtgccgcagttaacacaataagtatcccacctggggagtacgatcgcaaggttgaaactcaaa ggaattgacgggggcccgcacaagcggtggattatgtggtttaattcgaagcaacgcgaagaaccttaccagggcttgacatc ctactaacgaagtagagatacatcaggtgcccttcggggaaagtagagacaggtggtgcatggttgtcgtcagctcgtgtcgtg agatgttgggttaagtcccgcaacgagcgcaacccctattgttagttgctacgcaagagcactctagcgagactgccgttgaca aaacggaggaaggtggggacgacgtcaaatcatcatgccccttatgtcctgggctacacacgtaatacaatggcggtcaaca gagggaggcaaagccgcgaggcagagcaaaccccccaaaagccgtcccagttcggatcgcaggctgcaacccgcctgcgt gaagtcggaatcgctagtaatcgcggatcagcatgccgcggtgaatacgttcccgggccttgtacacaccgcccgtcacacca tgagagtcgggaacacccgaagtccgtagcctaaccgcaaggagggcgcggccgaaggtgggttcgataattggggtgaa gtcgtaacaaggtagccgtatcggaaggtgcggctggatcacctccttt |

TABLE 5-continued

Full length 16S rDNA sequences of species (negative correlates)

| Species Name | Sequence Identifier | 16S rDNA sequence |
|---|---|---|
| *Clostridium _sp_CAG_9 1* | SEQ ID NO: 266 | tagtggcggacgggtgagtaacgcgtgggtaacctgccttgtactgggggacaacagttggaaacgactgctaataccgcat aagcgcacagcttcgcatgaagcagtgtgaaaaactccggtggtacaagatggacccgcgtctgattagctggttggtgaggt aacggcccaccaaggcgacgatcagtagccggcctgagagggtgaacggccacattgggactgagacacggcccaaactc ctacgggaggcagcagtggggaatattgcacaatggggaaaccctgatgcagcaacgccgcgtgagtgaagaagtatttc ggtatgtaaagctctatcagcaggaaagaaaatgacggtacctgactaagaagccccggctaactacgtgccagcagccgcg gtaatacgtagggggcaagcgttatccggatttactgggtgtaaagggagcgtagacggttttgcaagtctgaagtgaaagcc cggggcttaaccccgggactgctttggaaactgtagaactagagtgcaggagaggtaagtggaattcctagtgtagcggtgaa atgcgtagatattaggaggaacaccagtggcgaaggcggcttactggactgtaactgacgttgaggctcgaaagcgtgggga gcaaacaggattagataccctggtagtccacgccgtaaacgatgattactaggtgttggtgggtacgacccatcggtgccgca gcaaacgcaataagtaatccacctggggagtacgttcgcaagaatgaaactcaaaggaattgacggggacccgcacaagcg gtggagcatgtggtttaattcgaagcaacgcgaagaaccttacctggtcttgacatccctatgaataacgggcaatgccgttagt acttcggtacataggagacaggtggtgcatggttgtcgtcagctcgtgtcgtgagatgttgggttaagtcccgcaacgagcgca acccttatctttagtagccagcagtaagatgggcactctagagagactgccggggataacccggaggaaggtggggatgacg tcaaatcatcatgccccttatgaccagggctacacacgtgctacaatggcgtaaacaaagagaagcgaagtcgtgaggcaga gcgaatctcaaaaataacgtctcagttcggattgtagtctgcaactcgactacatgaagctggaatcgctagtaatcgcagatca gaatgctgcggtgaatacgttcccgggtcttgtacacaccgcccgtcacaccatgggagtcggaaatgcccgaagtcggtga cctaaccgcaaggaaggagccgccgaaggcaggtctgataactggggtgaagtcgtaacaaggtagccgtatcggaaggt gcggctggatcacctccttt |
| *Ruminococc us_obeum* | SEQ ID NO: 267 | cctacgggaggcagcagtggggaatattgcacaatgggggaaaccctgatgcagcgacgccgcgtgaaggaagaagtatc tcggtatgtaaacttctatcagcagggaagatagtgacggtacctgactaagaagccccggctaactacgtgccagcagccgc ggtaatacgtagggggcaagcgttatccggatttactgggtgtaaagggagcgtagacggactggcaagtctgatgtgaaag gcgggggctcaacccctggactgcattggaaactgttagtcttgagtgccggagaggtaagcggaattcctagtgtagcggtg aaatgcgtagatattaggaggaacaccagtggcgaaggcggcttactggacggtaactgacgttgaggctcgaaagcgtgg ggagcaaacaggattagataccctggtagtccacgccgtaaacgatgaatactaggtgttggggagcaaagctcttcggtgcc gccgcaaacgcattaagtattccacctggggagtacgttcgcaagaatgaaactcaaaggaattgacggggacccgcacaag cggtggagcatgtggtttaattcgaagcaacgcgaagaaccttaccaagtcttgacatccctctgaccgactcttaaccgagtct ttccttcgggacagaggagacaggtggtgcatggttgtcgtcagctcgtgtcgtgagatgttgggttaagtcccgcaacgagcg caacccctatccccagtagccagcggttcggccgggcactctgaggagactgccagggataacctggaggaaggcgggga tgacgtcaaatcatcatgccccttatgatttgggctacacacgtgctacaatggcgtaaacaaagggaagcaagcctgcgaag gtaagcaaatcccaaaaataacgtcccagttcggactgcagtctgcaactcgactgcacgaagaggaatcgctagtaatcgc ggatcagaatgccgcggtgaatacgttcccgggtcttgtacacaccgcccgtcacaccatgggagtcagtaacgcccgaagt cagtgacctaaccgcaagggaggagctgccgaaggcgggaccgatgactggggtgaagtcgtaacaaggtagccgtatcg gaaggtgcggctggatcacctccttt |
| *Blautia sp.* | SEQ ID NO: 268 | atgagagtttgatcctggctcaggatgaacgctggcggcgtgcttaacacatgcaagtcgagcgaagcaatttaagtgaagtttt cggatggatcttagattgactgagcggcggacgggtgagtaacgcgtggataacctgcctcacacagggggataacagttag aaatgactgctaataccgcataagcgcacggtaccgcatggtacagtgtgaaaaactccggtggtgtgagatggatccgcgtc tgattaggtagttggtgaggtaacggcccaccaagccgacgatcagtagccgacctgagagggtgaccggccacattggga ctgagacacggcccaaactcctacgggaggcagcagtggggaatattgcacaatgggcgaaagcctgatgcagcaacgcc gcgtgagtgaagaagtatctcggtatgtaaagctctatcagcagggaagaaaatgacggtacctgactaagaagccccggcta actacgtgccagcagccgcggtaatacgtagggggcaagcgttatccggatttactgggtgtaaagggagcgcagacggca ctgcaagtctgaagtgaaagcccggggctcaaccccgggactgctttggaaactgtagagctagagtgctggagaggcaag cggaattcctagtgtagcggtgaaatgcgtagatattaggaagaacaccagtggcgaaggcggcttgctggacagtaactgac gttcaggctcgaaagcgtggggagcaaacaggattagataccctggtagtccacgccgtaaacgatgaatactaggtgttggt gggcaaagcccatcggtgccgccgcaaacgcaataagtattccacctggggagtacgttcgcaagaatgaaactcaaagga attgacggggacccgcacaagcggtggagcatgtggtttaattcgaagcaacgcgaagaaccttaccaagtcttgacatcgtg |

TABLE 5-continued

| Full length 16S rDNA sequences of species (negative correlates) | | |
|---|---|---|
| Species Name | Sequence Identifier | 16S rDNA sequence |
| | | atgaccggaacttaaccgttccttcccttcggggcatcatagacaggtggtgcatggttgtcgtcagctcgtgtcgtgagatgttg ggttaagtcccgcaacgagcgcaacccttatcctcagtagccagcagtaagatgggcactctggggagactgccagggataa cctggaggaaggtggggatgacgtcaaatcatcatgccccttatgatttgggctacacacgtgctacaatggcgtaaacaaag ggaagcaagagggtgacctggagcaaatcccaaaaataacgtcccagttcggactgtagtctgcaacccgactacacgaagc tggaatcgctagtaatcgcagatcagaatgctgcggtgaatacgttcccgggtcttgtacacaccgcccgtcacaccatggga gtcagcaacgcccgaagtcagtgactcaaccgcaaggagagagctgccgaaggcggggcaggtaactggggtgaagtcgt aacaaggtagccgtatcggaaggtgcggctggatcacctccttt |
| *Blautia_sp.* | SEQ ID NO: 269 | atgagagtttgatcctggctcaggatgaacgctggcggcgtgcttaacacatgcaagtcgagcgaagcaatttaagtgaagtttt cggatggatcttagattgactgagcggcggacgggtgagtaacgcgtggataacctgcctcacacagggggataacagttag aaatgactgctaataccgcataagcgcacggtaccgcatggtacagtgtgaaaaactccggtggtgtgagatggatccgcgtc tgattaggtagttggtgaggtaacggcccaccaagccgacgatcagtagccgacctgagagggtgaccggccacattggga ctgagacacggcccaaactcctacgggaggcagcagtggggaatattgcacaatgggcgaaagcctgatgcagcaacgcc gcgtgagtgaagaagtatctcggtatgtaaagctctatcagcagggaagaaaatgacggtacctgactaagaagccccggcta actacgtgccagcagccgcggtaatacgtagggggcaagcgttatccggatttactgggtgtaaagggagcgcagacggca ctgcaagtctgaagtgaaagcccggggctcaaccccgggactgctttggaaactgtagagctagagtgctggagaggcaag cggaattcctagtgtagcggtgaaatgcgtagatattaggaagaacaccagtggcgaaggcggcttgctggacagtaactgac gttcaggctcgaaagcgtggggagcaaacaggattagataccctggtagtccacgccgtaaacgatgaatactaggtgttggt gggcaaagcccatcggtgccgccgcaaacgcaataagtattccacctggggagtacgttcgcaagaatgaaactcaaagga attgacggggacccgcacaagcggtggagcatgtggtttaattcgaagcaacgcgaagaaccttaccaagtcttgacatcgtg atgaccggaacttaaccgttccttcccttcggggcatcatagacaggtggtgcatggttgtcgtcagctcgtgtcgtgagatgttg ggttaagtcccgcaacgagcgcaacccttatcctcagtagccagcagtaagatgggcactctgtggagactgccagggataa cctggaggaaggtggggatgacgtcaaatcatcatgccccttatgatttgggctacacacgtgctacaatggcgtaaacaaag ggaagcaagagggtgacctggagcaaatcccaaaaataacgtcccagttcggactgtagtctgcaacccgactacacgaagc tggaatcgctagtaatcgcagatcagaatgctgcggtgaatacgttcccgggtcttgtacacaccgcccgtcacaccatggga gtcagcaacgcccgaagtcagtgactcaaccgcaaggagagagctgccgaaggcggggcaggtaactggggtgaagtcgt aacaaggtagccgtatcggaaggtgcggctggatcacctccttt |
| *Lachnospira _pectinoschi za* | SEQ ID NO: 270 | ttatgagagtttgatcctggctcaggatgaacgctggcggcgtgcttaacacatgcaagtcgaacgaagcatttgcgacagattt cttcggattgaagttgcttatgactgagtggcggacgggtgagtaacgcgtgggtaacctgcctcacacagggggatagcagt tggaaacggctgataataccgcataagcgcacagtaccgcatggtacagtgtgaaaaactccggtggtgtgagatggacccg cgtctgattagcttgttggcagggtaacggcctaccaaggcaacgatcagtagccgacctgagagggtgaccggccacattg ggactgagacacggcccagactcctacgggaggcagcagtggggaatattgcacaatggaggaaactctgatgcagcgac gccgcgtgagtgaagaagtaattcgttatgtaaagctctatcagcagggaagatagtgacggtacctgactaagaagctccgg ctaaatacgtgccagcagccgcggtaatacgtatggagcaagcgttatccggatttactgggtgtaaagggagtgtaggtggc atcacaagtcagaagtgaaagcccggggctcaaccccgggactgcttttgaaactgtggagctggagtgcaggagaggcaa gtggaattcctagtgtagcggtgaaatgcgtagatattaggaggaacaccagtggcgaaggcggcttgctggactgtaactga cactgaggctcgaaagcgtggggagcaaacaggattagataccctggtagtccacgccgtaaacgatgaatactaggtgtcg gggctcataagagcttcggtgccgcagcaaacgcaataagtattccacctggggagtacgttcgcaagaatgaaactcaaag gaattgacggggacccgcacaagcggtggagcatgtggtttaattcgaagcaacgcgaagaaccttaccaagtcttgacatcc tcttgcccggtcagtaatgtgaccttttcttcggaacaagagtgacaggtggtgcatggttgtcgtcagctcgtgtcgtgagatgtt gggttaagtcccgcaacgagcgcaacccctattcttagtagccagcatttaaggtgggcactctaggaagactgccagggata acctggaggaaggtggggatgacgtcaaatcatcatgccccttatgacttgggctacacacgtgctacaatggcgtaaacaaa gtgaagcgagagtgtgagcttaagcaaatcacaaaaataacgtctcagttcggattgtagtctgcaactcgactacatgaagct ggaatcgctagtaatcgcgaatcagaatgtcgcggtgaatacgttcccgggtcttgtacacaccgcccgtcacaccatgggag tcggaaatgcccgaagtcggtgacctaacgaaagaaggagccgccgaaggcaggtctgataactggggtgaagtcgtaaca aggtagccgtatcggaaggtgcggctggatcacctccttt |

TABLE 5-continued

Full length 16S rDNA sequences of species (negative correlates)

| Species Name | Sequence Identifier | 16S rDNA sequence |
|---|---|---|
| *Lactonifactor_longoviformis* | SEQ ID NO: 271 | ctgagagggtgaccggccacattgggactgagacacggcccaaactcctacgggaggcagcagtggggaatattgcacaat<br>gggggaaaccctgatgcagcgacgccgcgtgaaggaagaagtatttcggtatgtaaacttctatcagcagggaagaaaatga<br>cggtacctgactaagaagccccggctaattacgtgccagcagccgcggtaatacgtaaggggcaagcgttatccggatttact<br>gggtgtaaagggagcgtagacggcagtgcaagtctgatgtgaaagcccggggctcaaccccgggactgcattggaaactgt<br>gcagctagagtgtcggagaggtaagtggaattcctagtgtagcggtgaaatgcgtagatattaggaggaacaccagtggcga<br>aggcggcttactggacgataactgacgttgaggctcgaaagcgtggggagcaaacaggattagataccctggtagtccacgc<br>cgtaaacgatgaatactaggtgtcgggcgccaaaggcgttcggtgccgcagcaaacgcaataagtattccacctggggagta<br>cgttcgcaagaatgaaactcaaaggaattgacggggacccgcacaagcggtggagcatgtggtttaattcgaagcaacgcga<br>agaaccttaccaagtcttgacatctgcctgaccggtccgtaacaggacccttccttcgggacaggcaagacaggtggtgcatg<br>gttgtcgtcagctcgtgtcgtgagatgttgggttaagtcccgcaacgagcgcaacccttatccttagtagccagcaggtagagct<br>gggcactctagggagactgccagggacaacctggaggaaggtggggatgacgtcaaatcatcatgccccttatgatttgggc<br>tacacacgtgctacaatggcgtaaacaaagggaggcgaaggggtgacctggagcaaatcccaaaaataacgtctcagttcgg<br>attgtagtctgcaactcgactacatgaagctggaatcgctagtaatcgcgaatcagaatgtcgcggtgaatacgttcccgggtct<br>tgtacacaccgcccgtcacaccatgggagtcggatatgcccgaagccggtgaccgaacccgaaagggaaggagccgtcga<br>aggtggagccgataactggggtgaagtcgtaacaaggtagccgtatcggaaggtgcggctggatcacctccttt |
| *Eubacterium contortum* | SEQ ID NO: 272 | aacgagagtttgatcctggctcaggatgaacgctggcggcgtgcttaacacatgcaagtcgagcgaagcgctttacttagattt<br>cttcggattgaagagttttgcgactgagcggcggacgggtgagtaacgcgtgggtaacctgcctcatacaggggataacagt<br>tagaaatgactgctaataccgcataagaccacagtaccgcatggtaccgtgggaaaaactccggtggtatgagatggacccgc<br>gtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgaaggatgaagtatttcggtatgtaaacttctatcagcagggaagaaaatgacggtacctgactaagaagccccggc<br>taactacgtgccagcagccgcggtaatacgtagggggcaagcgttatccggatttactgggtgtaaagggagcgtagacggtt<br>atgtaagtctgatgtgaaaacccggggctcaaccccgggactgcattggaaactatgtaactagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgcatactaggtgtcgggt<br>ggcaaagccattcggtgccgcagcaaacgcaataagtatgccacctggggagtacgttcgcaagaatgaaactcaaaggaat<br>tgacggggacccgcacaagcggtggagcatgtggtttaattcgaagcaacgcgaagaaccttacctgctcttgacatccccct<br>gaccggcgcgtaatggtgcctttccttcgggacaggggagacaggtggtgcatggttgtcgtcagctcgtgtcgtgagatgttg<br>ggttaagtcccgcaacgagcgcaacccttatctttagtagccagcggttcggccgggcactctagagagactgccagggataa<br>cctggaggaaggtggggatgacgtcaaatcatcatgccccttatgagcagggctacacacgtgctacaatggcgtaaacaaa<br>gggaggcgaagccgcgaggtggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gttggtaacgcccgaagtcagtgacccaaccgtaaggagggagctgccgaaggtgggaccgataactggggtgaagtcgta<br>acaaggtagccgtatcggaaggtgcggctggatcacctccttt |
| *Eubacterium_contortum* | SEQ ID NO: 273 | aacgagagtttgatcctggctcaggatgaacgctggcggcgtgcttaacacatgcaagtcgagcgaagcgctttacttagattt<br>cttcggattgaagagttttgcgactgagcggcggacgggtgagtaacgcgtgggtaacctgcctcatacaggggacaacag<br>ttagaaatgactgctaataccgcataagaccacggtaccgcatggtacagtgggaaaaactccggtggtatgagatggacccg<br>cgtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgaaggatgaagtatttcggtatgtaaacttctatcagcagggaagaaaatgacggtacctgactaagaagccccggc<br>taactacgtgccagcagccgcggtaatacgtagggggcaagcgttatccggatttactgggtgtaaagggagcgtagacggtt<br>atgtaagtctgatgtgaaaacccggggctcaaccccgggactgcattggaaactatgtaactagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgcatactaggtgtcgggt<br>ggcaaagccattcggtgccgcagcaaacgcaataagtatgccacctggggagtacgttcgcaagaatgaaactcaaaggaat<br>tgacggggacccgcacaagcggtggagcatgtggtttaattcgaagcaacgcgaagaaccttacctgctcttgacatccccct |

TABLE 5-continued

| Full length 16S rDNA sequences of species (negative correlates) | | |
|---|---|---|
| Species Name | Sequence Identifier | 16S rDNA sequence |
| | | gaccggcgcgtaatggtgcctttccttcgggacaggggagacaggtggtgcatggttgtcgtcagctcgtgtcgtgagatgttg<br>ggttaagtcccgcaacgagcgcaacccttatctttagtagccagcggttcggccgggcactctagagagactgccagggataa<br>cctggaggaaggtggggatgacgtcaaatcatcatgccccttatgagcagggctacacacgtgctacaatggcgtaaacaaa<br>gggaggcgaagccgcgaggtggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gttggtaacgcccgaagtcagtgacccaaccgtaaggagggagctgccgaaggtgggaccgataactggggtgaagtcgta<br>acaaggtagccgtatcggaaggtgcggctggatcacctccttt |
| *Eubacterium _contortum* | SEQ ID NO: 274 | aacgagagtttgatcctggctcaggatgaacgctggcggcgtgcttaacacatgcaagtcgagcgaagcgctttacttagattt<br>cttcggattgaagagttttgcgactgagcggcggacgggtgagtaacgcgtgggtaacctgcctcatacaggggataacagt<br>tagaaatgactgctaataccgcataagaccacggtaccgcatggtacagtgggaaaaactccggtggtatgagatggacccg<br>cgtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgaaggatgaagtatttcggtatgtaaacttctatcagcagggaagaaaatgacggtacctgactaagaagccccggc<br>taactacgtgccagcagccgcggtaatacgtagggggcaagcgttatccggatttactgggtgtaaagggagcgtagacggtt<br>atgtaagtctgatgtgaaaacccggggctcaaccccgggactgcattggaaactatgtaactagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgcatactaggtgtcgggt<br>ggcaaagccattcggtgccgcagcaaacgcaataagtatgccacctggggagtacgttcgcaagaatgaaactcaaaggaat<br>tgacggggacccgcacaagcggtggagcatgtggtttaattcgaagcaacgcgaagaaccttacctgctcttgacatcccccct<br>gaccggcgcgtaatggtgcctttccttcgggacaggggagacaggtggtgcatggttgtcgtcagctcgtgtcgtgagatgttg<br>ggttaagtcccgcaacgagcgcaacccttatctttagtagccagcggttcggccgggcactctagagagactgccagggataa<br>cctggaggaaggtggggatgacgtcaaatcatcatgccccttatgagcagggctacacacgtgctacaatggcgtaaacaaa<br>gggaggcgaagccgcgaggtggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gttggtaacgcccgaagtcagtgacccaaccgtaaggagggagctgccgaaggtgggaccgataactggggtgaagtcgta<br>acaaggtagccgtatcggaaggtgcggctggatcacctccttt |
| *Eubacterium _contortum* | SEQ ID NO: 275 | aacgagagtttgatcctggctcaggatgaacgctggcggcgtgcttaacacatgcaagtcgagcgaagcactttacttagatttc<br>ttcggaatgaagagtgttgtgactgagcggcggacgggtgagtaacgcgtgggtaacctgcctcatacaggggataacagt<br>tagaaatgactgctaataccgcataagaccacggtaccgcatggtacagtgggaaaaactccggtggtatgagatggacccg<br>cgtctgattagctagttggtaaggtaacggcttaccaaggcgacgatcagtagccgacctgagagggtgaccggccacattgg<br>gactgagacacggcccaaactcctacgggaggcagcagtggggaatattgcacaatgggggaaaccctgatgcagcgacg<br>ccgcgtgaaggatgaagtatttcggtatgtaaacttctatcagcagggaagaaaatgacggtacctgactaagaagccccggc<br>taactacgtgccagcagccgcggtaatacgtagggggcaagcgttatccggatttactgggtgtaaagggagcgtagacggtt<br>atgtaagtctgatgtgaaaacccggggctcaaccccgggactgcattggaaactatgtaactagagtgtcggagaggtaagtg<br>gaattcctagtgtagcggtgaaatgcgtagatattaggaggaacaccagtggcgaaggcggcttactggacgatgactgacgt<br>tgaggctcgaaagcgtggggagcaaacaggattagataccctggtagtccacgccgtaaacgatgcatactaggtgtcgggt<br>ggcaaagccattcggtgccgcagcaaacgcaataagtatgccacctggggagtacgttcgcaagaatgaaactcaaaggaat<br>tgacggggacccgcacaagcggtggagcatgtggtttaattcgaagcaacgcgaagaaccttacctgctatgacatcccccct<br>gaccggcgcgtaatggtgcctttccttcgggacaggggagacaggtggtgcatggttgtcgtcagctcgtgtcgtgagatgttg<br>ggttaagtcccgcaacgagcgcaacccttatctttagtagccagcggttcggccgggcactctagagagactgccagggataa<br>cctggaggaaggtggggatgacgtcaaatcatcatgccccttatgagcagggctacacacgtgctacaatggcgtaaacaaa<br>gggaggcgaagccgcgaggtggagcaaatcccaaaaataacgtctcagttcggattgtagtctgcaactcgactacatgaag<br>ctggaatcgctagtaatcgcgaatcagaatgtcgcggtgaatacgttcccgggtcttgtacacaccgcccgtcacaccatggga<br>gttggtaacgcccgaagtcagtgacccaaccgtaaggagggagctgccgaaggtgggaccgataactggggtgaagtcgta<br>acaaggtagccgtatcggaaggtgcggctggatcacctccttt |

TABLE 5-continued

Full length 16S rDNA sequences of species (negative correlates)

| Species Name | Sequence Identifier | 16S rDNA sequence |
|---|---|---|
| *Eisenbergiella_tayi* | SEQ ID NO: 276 | ggagaggtaagcggaattcctagtgtagcggtgaaatgcgtagatattaggaggaacaccagtggcgaaggcggcttactgg actgtaactgacgttgaggctcgaaagcgtggggagcaaacaggattagataccctggtagtccacgcggtaaacgatgattg ctaggtgtaggtgggtatggacccatcggtgccgcagctaacgcaataagcaatccacctggggagtacgttcgcaagaatg aaactcaaaggaattgacggggacccgcacaagcggtggagcatgtggtttaattcgaagcaacgcgaagaaccttaccaag tcttgacatcccccctgaatatctcgtaaaagggataggccttcgggacaggggagacaggtggtgcatggttgtcgtcagctcg tgtcgtgagatgttgggttaagtcccgcaacgagcgcaacccttattcttagtagccagcaggtaaagctgggcactctaagga gactgccggggataacccggaggaaggcggggatgacgtcaaatcatcatgccccttatgatttgggctacacacgtgctac aatggcgtaaacaaagggaagcgagacagtgatgtggagcaaatcccagaaataacgtctcagttcggattgtagtctgcaac tcgactacatgaagctggaatcgctagtaatcgcgaatcagcatgtcgcggtgaatacgttcccgggtcttgtacacaccgccc gtcacaccatgggagttggaaatgcccgaagtctgtgacctaaccgaaagggaggagcagccgaaggcaggtctgataact ggggtgaagtcgtaacaaggtagccgtatcggaaggtgcggctggatcacctccttt |
| *Ruminococcus_gnavus_sp* | SEQ ID NO: 277 | aacgagagtttgatcctggctcaggatgaacgctggcggcgtgcttaacacatgcaagtcgagcgaagcgcttttgcggatttc ttcggattgaagcaactgtgactgagcggcggacgggtgagtaacgcgtgggtaacctgcctcatacaggggggataacagtt ggaaacggctgctaataccgcataagcgcacagtaccgcatggtaccgtgtgaaaaactccggtggtatgagatggacccgc gtctgattagctagttggtggggtaacggcctaccaaggcgacgatcagtagccgacctgagagggtgaccggccacattgg gactgagacacggcccaaactcctacgggaggcagcagtggggaatattgcacaatggggaaaccctgatgcagcgacg ccgcgtgagcgatgaagtatttcggtatgtaaagctctatcagcagggaagaaaatgacggtacctgactaagaagccccggc taactacgtgccagcagccgcggtaatacgtagggggcaagcgttatccggatttactgggtgtaaagggagcgtagacggc atggcaagccagatgtgaaagcccggggctcaaccccgggactgcatttggaactgtcaggctagagtgtcggagaggtaa gcggaattcctagtgtagcggtgaaatgcgtagatattaggaggaacaccagtggcgaaggcggcttactggacgatgactg acgttgaggctcgaaagcgtggggagcaaacaggattagataccctggtagtccacgccgtaaacgatgaatactaggtgtc gggtggcaaagccattcggtgccgcagcaaacgcaataagtattccacctggggagtacgttcgcaagaatgaaactcaaag gaattgacggggacccgcacaagcggtggagcatgtggtttaattcgaagcaacgcgaagaaccttacctggtcttgacatcc ctatgaccgctctttaatcggagctttccttcgggacagaggagacaggtggtgcatggttgtcgtcagctcgtgtcgtgagatg ttgggttaagtcccgcaacgagcgcaacccctatctttagtagccagcattttggatgggcactctagagagactgccagggat aacctggaggaaggtggggatgacgtcaaatcatcatgccccttatgaccagggctacacacgtgctacaatggcgtaaacaa agggaagcgaacctgcgagggggagcaaatcccaaaaataacgtctcagttcggattgtagtctgcaactcgactacatgaa gctggaatcgctagtaatcgcgaatcagaatgtcgcggtgaatacgttcccgggtcttgtacacaccgcccgtcacaccatgg gagtcagtaacgcccgaagtcagtgacccaaccgtaaggagggagctgccgaaggtgggaccgataactggggtgaagtc gtaacaaggtagccgtatcggaaggtgcggctggatcacctccttt |
| *Clostridium_aldenense_sp* | SEQ ID NO: 278 | tttgagagtttgatcctggctcaggatgaacgctggcggcgtgcctaacacatgcaagtcgaacgaagcgattaggatgaagtt ttcggatggattcctggttgactgagtggcggacgggtgagtaacgcgtggataacctgcctcacactgggggataacagtta gaaatggctgctaataccgcataagcgcacagtaccgcatggtacggtgtgaaaaacccaggtggtgtgagatggatccgcg tctgattagccagttggcggggtaacggcccaccaaagcgacgatcagtagccgacctgagagggtgaccggccacattgg gactgagacacggcccaaactcctacgggaggcagcagtggggaatattgcacaatgggcggaagcctgatgcagcgacg ccgcgtgagtgaagaagtatctcggtatgtaaagctctatcagcagggaagaaaatgacggtacctgactaagaagccccgg ctaactacgtgccagcagccgcggtaatacgtagggggcaagcgttatccggatttactgggtgtaaagggagcgtagacgg cgacgcaagtctggagtgaaagcccggggcccaaccccgggactgctttggaaactgtgctgctggagtgcaggagaggta agtggaattcctagtgtagcggtgaaatgcgtagatattaggaggaacaccagtggcgaaggcggcttactggactgtaactg acgttgaggctcgaaagcgtggggagcaaacaggattagataccctggtagtccacgccgtaaacgatgaatgctaggtgtc ggggggcaaagcccttcggtgccgccgctaacgcaataagcattccacctggggagtacgttcgcaagaatgaaactcaaag gaattgacggggacccgcacaagcggtggagcatgtggtttaattcgaagcaacgcgaagaaccttaccaagtcttgacatcc ccctgaccggcgcgtaacggtgcccttccttcgggacaggggagacaggtggtgcatggttgtcgtcagctcgtgtcgtgag atgttgggttaagtcccgcaacgagcgcaacccttatccttagtagccagcacgtcgtggtgggcactctagggagactgcca gggataacctggaggaaggtggggatgacgtcaaatcatcatgccccttatgatttgggctacacacgtgctacaatggcgtaa acaaagggaggcgaccctgcgaaggtaagcaaatcccaaaaataacgtcccagttcggactgtagtctgcaacccgactaca |

TABLE 5-continued

| Full length 16S rDNA sequences of species (negative correlates) | | |
|---|---|---|
| Species Name | Sequence Identifier | 16S rDNA sequence |
| | | cgaagctggaatcgctagtaatcgcggatcagaatgccgcggtgaatacgttcccgggtcttgtacacaccgcccgtcacacc atgggagtcagcaacgcccgaagtcagtgacccaaccttaacaggagggagctgccgaaggcggggcaggtaactggggt gaagtcgtaacaaggtagccgtatcggaaggtgcggctggatcacctccttt |
| *Clostridium _sp* | SEQ ID NO: 279 | acgagagtttgatcctggctcaggacgaacgctggcggcgtgcctaacacatgcaagtcgaacgagaatctttgaacagatct tttcggagtgacgttcaaagaggaaagtggcggacgggcgagtaacgcgtgagtaacctgcccataagaggggataatcc atggaaacgtggactaataccgcatattgtagttaagttgcatgacttgattatgaaagatttatcgcttatggatggactcgcgtc agattagatagttggtgaggtaacggctcaccaagtcaacgatctgtagccgaactgagaggttgatcggccgcattgggact gagacacggcccagactcctacgggaggcagcagtggggaatattgcgcaatgggggcaaccctgacgcagcaacgccg cgtgcaggaagaaggtcttcggattgtaaactgttgtcgcaagggaagaagacagtgacggtaccttgtgagaaagtcacgg ctaactacgtgccagcagccgcggtaatacgtaggtgacaagcgttgtccggatttactgggtgtaaagggcgcgtaggcgg actgtcaagtcagtcgtgaaataccggggcttaaccccggggctgcgattgaaactgacagccttgagtatcggagaggaaa gcggaattcctagtgtagcggtgaaatgcgtagatattaggaggaacaccagtggcgaaggcggctttctggacgacaactg acgctgaggcgcgaaagtgtggggagcaaacaggattagataccctggtagtccacaccgtaaacgatggatactaggtgta ggaggtatcgaccccttctgtgccgcagttaacacaataagtatcccacctggggagtacgaccgcaaggttgaaactcaaag gaattgacgggggcccgcacaagcagtggagtatgtggtttaattcgaagcaacgcgaagaaccttacctgggcttgacatcc ctggaatcgagtagagatacttgagtgccttcgggaatcaggtgacaggtggtgcatggttgtcgtcagctcgtgtcgtgagat gttgggttaagtcccgcaacgagcgcaacccctattgtcagttgccatcattaagttgggcactctggcgagactgccggtgac aaatcggaggaaggtggggacgacgtcaaatcatcatgccccttatgcccagggctacacacgtactacaatggccgataac aaagtgcagcgaaaccgtgaggtggagcgaatcacaaaactcggtctcagttcagattgcaggctgcaactcgcctgcatga agttggaattgctagtaatcgcggatcagaatgccgcggtgaatacgttcccgggccttgtacacaccgcccgtcacaccatga gagtcgataacacccgaagcctgtgagctaacctttaggaggcagcagtcgaaggtggggttgatgattggggtgaagtcgta acaaggtagccgtatcggaaggtgcggctggatcacctccttt |
| *Clostridium _lavalense* | SEQ ID NO: 280 | tttgagagtttgatcctggctcaggatgaacgctggcggcgtgcctaacacatgcaagtcgaacgaagcatttcagatgaagttt tcggatggattctgagatgactgagtggcggacgggtgagtaacacgtggataacctgcctcacactgggggacaacagtta gaaatgactgctaataccgcataagcgcacagtaccgcatggtacagtgtgaaaaactccggtggtgtgagatggatccgcgt ctgattagccagttggcggggtaacggcccaccaaagcgacgatcagtagccgacctgagagggtgaccggccacattggg actgagacacggcccaaactcctacgggaggcagcagtggggaatattgcacaatgggcgaaagcctgatgcagcgacgc cgcgtgagtgaagaagtatttcggtatgtaaagctctatcagcagggaagataatgacggtacctgactaagaagccccggct aactacgtgccagcagccgcggtaatacgtagggggcaagcgttatccggatttactgggtgtaaagggagcgtagacggca tggcaagtctgaagtgaaaacccagggctcaaccctgggactgctttggaaactgtcaagctagagtgcaggagaggtaagt ggaattcctagtgtagcggtgaaatgcgtagatattaggaggaacaccagtggcgaaggcggcttactggactgtaactgacg ttgaggctcgaaagcgtggggagcaaacaggattagataccctggtagtccacgccgtaaacgatgagtgctaggtgttggg gggcaaagcccttcggtgccgtcgcaaacgcaataagcactccacctggggagtacgttcgcaagaatgaaactcaaagga attgacggggacccgcacaagcggtggagcatgtggtttaattcgaagcaacgcgaagaaccttaccaagtcttgacatcctct tgaccggcgtgtaacggcgcctttccttcgggacaagggagacaggtggtgcatggttgtcgtcagctcgtgtcgtgagatgtt gggttaagtcccgcaacgagcgcaacccttatccttagtagccagcattaagatgggcactctagggagactgccagggaca acctggaggaaggtggggatgacgtcaaatcatcatgccccttatgatttgggctacacacgtgctacaatggcgtaaacaaa gggaagcgaccctgcgaaggtgagcaaatctcaaaaataacgtcccagttcggactgtagtctgcaacccgactacacgaag ctggaatcgctagtaatcgcgaatcagaatgtcgcggtgaatacgttcccgggtcttgtacacaccgcccgtcacaccatggga gtcagcaacgcccgaagtcagtgacccaactcgcaagagagggagctgccgaaggcggggcaggtaactggggtgaagt cgtaacaaggtagccgtatcggaaggtgcggctggatcacctccttt |
| *Blautia_pro ducta* | SEQ ID NO: 281 | AGAGTTTGATCCTGGCTCAGGATGAACGCTGGCGGCGTGCTTAACACATGCA AGTCGAGCGAAGCACTAAGACGGATTTCTTCGGATTGAAGTCTTTGTGACTG AGCGGCGGACGGGTGAGTAACGCGTGGGTAACCTGCCTCATACAGGGGGAT AACAGTTAGAAATGACTGCTAATACCGCATAAGCGCACAGGACCGCATGGT |

TABLE 5-continued

| Full length 16S rDNA sequences of species (negative correlates) | | |
|---|---|---|
| Species Name | Sequence Identifier | 16S rDNA sequence |
| | | CTGGTGTGAAAAACTCCGGTGGTATGAGATGGACCCGCGTCTGATTAGCTAG<br>TTGGAGGGGTAACGGCCCACCAAGGCGACGATCAGTAGCCGGCCTGAGAGG<br>GTGAACGGCCACATTGGGACTGAGACACGGCCCAGACTCCTACGGGAGGCA<br>GCAGTGGGGAATATTGCACAATGGGGGAAACCCTGATGCAGCGACGCCGCG<br>TGAAGGAAGAAGTATCTCGGTATGTAAACTTCTATCAGCAGGGAAGAAAAT<br>GACGGTACCTGACTAAGAAGCCCCGGCTAACTACGTGCCAGCAGCCGCGGT<br>AATACGTAGGGGGCAAGCGTTATCCGGATTTACTGGGTGTAAAGGGAGCGT<br>AGACGGAAGAGCAAGTCTGATGTGAAAGGCTGGGGCTTAACCCCAGGACTG<br>CATTGGAAACTGTTGTTCTAGAGTGCCGGAGAGGTAAGCGGAATTCCTAGTG<br>TAGCGGTGAAATGCGTAGATATTAGGAGGAACACCAGTGGCGAAGGCGGCT<br>TACTGGACGGTAACTGACGTTGAGGCTCGAAAGCGTGGGGAGCAAACAGGA<br>TTAGATACCCTGGTAGTCCACGCCGTAAACGATGAATACTAGGTGTCGGGTG<br>GCAAAGCCATTCGGTGCCGCAGCAAACGCAATAAGTATTCCACCTGGGGAG<br>TACGTTCGCAAGAATGAAACTCAAAGGAATTGACGGGGACCCGCACAAGCG<br>GTGGAGCATGTGGTTTAATTCGAAGCAACGCGAAGAACCTTACCAAGTCTTG<br>ACATCCCTCTGACCGTCCCGTAACGGGGACTTCCCTTCGGGGCAGAGGAGAC<br>AGGTGGTGCATGGTTGTCGTCAGCTCGTGTCGTGAGATGTTGGGTTAAGTCC<br>CGCAACGAGCGCAACCCTTATCCTTAGTAGCCAGCACATGATGGTGGGCACT<br>CTAGGGAGACTGCCGGGGATAACCCGGAGGAAGGCGGGGACGACGTCAAA<br>TCATCATGCCCCTTATGATTTGGGCTACACACGTGCTACAATGGCGTAAACA<br>AAGGGAAGCGAGACAGCGATGTTGAGCGAATCCCAAAAATAACGTCCCAGT<br>TCGGACTGCAGTCTGCAACTCGACTGCACGAAGCTGGAATCGCTAGTAATCG<br>CGGATCAGAATGCCGCGGTGAATACGTTCCCGGGTCTTGTACACACCGCCCG<br>TCACACCATGGGAGTCAGTAACGCCCGAAGTCAGTGACCTAACCGAAAGGA<br>AGGAGCTGCCGAAGGCGGGACCGATAACTGGGGTGAAGTCGTAACAAGGTA<br>ACC |
| *Clostridium _nexile* | SEQ ID NO: 282 | NNNNNNNGAGATTTGATCCTGGCTCAGGATGAACGCTGGCCGGCCGTGCTT<br>ACACATGCAGTCGAACGAAGCGCTTAAACTGGATTTCTTCGGATTGAAGTTT<br>TTGCTGACTGAGTGGCGGACGGGTGAGTAACGCGTGGGTAACCTGCCTCAT<br>ACAGGGGGATAACAGTTAGAAATGACTGCTAATACCNNATAAGCGCACAGT<br>GCTGCATGGCACAGTGTAAAAACTCCGGTGGTATGAGATGGACCCGCGTCT<br>GATTAGCTAGTTGGTGGGGTAACGGCCTACCAAGGCGACGATCAGTAGCCG<br>GCCTGAGAGGGTGAACGGCCACATTGGGACTGAGACACGGNCCAAACTCCT<br>ACGGGAGGCAGCAGTGGGGAATATTGCACAATGGGGGAAACCCTGATGCAG<br>CGACGCCGCGTGAGCGAAGAAGTATTTNGGTATGTAAAGCTCTATCAGCAG<br>GGAAGAAAATGACGGTACCTGACTAAGAAGCACCGGCTAAATACGTGCCAG<br>CAGCCGCGGTAATACGTAGGTGCAAGCGTTATCCGGATTTACTGGGTGTAAA<br>GGGAGCGTAGACGGTTGTGTAAGTCTGATGTGAAAGCCCGGGGCTCAACCC<br>CGGACTGCATTGGAAACTATGTAACTAGAGTGTCGGAGAGGTAAGCGGAAT<br>TCCTAGTGTAGCGGTGAAATGCGTAGATATTAGGAGGAACACCAGTGGCGA<br>AGGCGGCTTACTGGACGATCACTGACGTTGAGGCTCGAAAGCGTGGGGAGC<br>AAACAGGATTAGATACCCTGGTAGTCCACGCCGTAAACGATGACTACTAGG<br>TGTCGGGGAGCAAAGCTCTTCGGTGCCGCAGCAAACGCAATAAGTAGTCCA<br>CCTGGGGAGTACGTTCGCAAGAATGAAACTCAAAGGAATTGACGGGGACCC<br>GCACAAGCGTGGAGCATGTGGTTTAATTCGAGCAACGCGAAGACCTTACCT<br>GGTCTTGACATCCCGGTGACCGGTCCAGTAATGGGACCTTTCCTTCGGGACA<br>CGGTGACAGGTGGTGCATGGTTGTCGTCAGCTCGTGTCGTGAGATGTTGGGT |

TABLE 5-continued

Full length 16S rDNA sequences of species (negative correlates)

| Species Name | Sequence Identifier | 16S rDNA sequence |
|---|---|---|
| | | TAAGTCCCGCAACGAGCGCAACCCCTATCTTCAGTAGCCAGCATTTAAGGTG<br>GGCACTCTGGAGAGACTGCCAGGGATAACCTGGAGGAAGGTGGGGATGACG<br>TCAAATCATCATGCCCCTTATGACCAGGGCTACACACGTGCTACAATGGCGT<br>AAACAAAGGGAAGCGAACCTGTGAGGGGAAGCAAATCTCAAAAATAACGT<br>CTCAGTTCGGATTGTAGTCTGCAACTCGACTACATGAAGCTGGAATCGCTAG<br>TAATCGCGAATCAGCATGTCGCGGTGAATACGTTCCCGGGTCTTGTACACAC<br>CGCCCGTCACACCATGGGAGTCAGTAACGCCCGAAGTCAGTGACCCAACCG<br>TAAGGAGGGAGCTGCCGAAGGTGGGACCGATAACTGGGGTGAAGTCGTAAC<br>AAGGTAGCCGTATCGGAAGGTGCGGCTGGATCACCTCC |
| *Roseburia_i nulinivorans* | SEQ ID NO: 283 | TTGATCCTGGCTCAGGATGAACGCTGGCGGCGTGCTTAACACATGCAAGTCG<br>AACGAAGCACTTTTACAGATTTCTTCGGAATGAAGTTTTAGTGACTGAGTGG<br>CGGACGGGTGAGTAACGCGTGGGTAACCTGCCTCACACAGGGGGATAACAG<br>TTGGAAACGGCTGCTAATACCGCATAAGCGCACAGTACCGCATGGTACAGT<br>GTGAAAAACTCCGGTGGTGTGAGATGGACCCGCGTCTGATTAGCTAGTTGGC<br>AGGGCAACGGCCTACCAAGGCGACGATCAGTAGCCGACCTGAGAGGGTGAC<br>CGGCCACATTGGGACTGAGACACGGCCCAAACTCCTACGGGAGGCAGCAGT<br>GGGGAATATTGCACAATGGGGGAAACCCTGATGCAGCGACGCCGCGTGAGC<br>GAAGAAGTATTTCGGTATGTAAAGCTCTATCAGCAGGGAAGAAGAAATGAC<br>GGTACCTGACTAAGAAGCACCGGCTAAATACGTGCCAGCAGCCGCGGTAAT<br>ACGTATGGTGCAAGCGTTATCCGGATTTACTGGGTGTAAAGGGAGCGCAGG<br>CGGAAGGCTAAGTCTGATGTGAAAGCCCGGGGCTCAACCCCGGTACTGCAT<br>TGGAAACTGGTCATCTAGAGTGTCGGAGGGGTAAGTGGAATTCCTAGTGTA<br>GCGGTGAAATGCGTAGATATTAGGAGGAACACCAGTGGCGAAGGCGGCTTA<br>CTGGACGATAACTGACGCTGAGGCTCGAAAGCGTGGGGAGCAAACAGGATT<br>AGATACCCTGGTAGTCCACGCCGTAAACGATGAATACTAGGTGTCGGAAAG<br>CACAGCTTTTCGGTGCCGCCGCAAACGCATTAAGTATTCCACCTGGGGAGTA<br>CGTTCGCAAGAATGAAACTCAAAGGAATTGACGGGGACCCGCACAAGCGGT<br>GGAGCATGTGGTTTAATTCGAAGCAACGCGAAGAACCTTACCAAGTCTTGA<br>CATCCTTCTGACCGGACAGTAATGTGTCCTTTCCTTCGGGACAGAAGTGACA<br>GGTGGTGCATGGTTGTCGTCAGCTCGTGTCGTGAGATGTTGGGTTAAGTCCC<br>GCAACGAGCGCAACCCTTATCCCCAGTAGCCAGCGGTTCGGACGGGCACTC<br>TGAGGAGACTGCCAGGGATAACCTGGAGGAAGGTGGGGATGACGTCAAATC<br>ATCATGCCCCTTATGACTTGGGCTACACACGTGCTACAATGGCGTAAACAAA<br>GGGAAGCGAGACCGTGAGGTGGAGCAAATCCCAAAAATAACGTCTCAGTTC<br>GGACTGTAGTCTGCAACCCGACTACACGAAGCTGGAATCGCTAGTAATCGC<br>AGATCAGAATGCTGCGGTGAATACGTTCCCGGGTCTTGTACACACCGCCCGT<br>CACACCATGGGAGTTGGAAATGCCCGAAGTCAGTGACCCAACCGCAAGGAG<br>GGAGCTGCGAAGGCAGGT |
| *Streptococc us_infantis* | SEQ ID NO: 284 | GAACGGGTGAGTAACGCGTAGGTAACCTGCCTGGTAGCGGGGGATAACTAT<br>TGGAAACGATAGCTAATACCGCATAACAGTAGATATCGCATGATAGCTGCTT<br>GAAAGGTGCAATTGCACCACTACCAGATGGACCTGCGTTGTATTAGCTAGTT<br>GGTGAGGTAACGGCTCACCAAGGCRACGATACATAGCCGACCTGAGAGGGT<br>GATCGGCCACACTGGGACTGAGACACGGCCCAGACTCCTACGGGAGGCAGC<br>AGTAGGGAATCTTCGGCAATGGACGGAAGTCTGACCGAGCAACGCCGCGTG<br>AGTGAAGAAGGTTTTCGGATCGTAAAGCTCTGTTGTAAGAGAAGAACGAGT<br>GTGAGAGTGGAAAGTTCACACTGTGACGGTATCTTACCAGAAAGGGACGGC |

TABLE 5-continued

| Full length 16S rDNA sequences of species (negative correlates) | | |
|---|---|---|
| Species Name | Sequence Identifier | 16S rDNA sequence |
| | | TAACTACGTGCCAGCAGCCGCGGTAATACGTAGGTCCCGAGCGTTGTCCGG<br>ATTTATTGGGCGTAAAGCGAGCGCAGGCGGTTAGATAAGTCTGAAGTTAAA<br>GGCTGTGGCTTAACCATAGTACGCTTTGGAAACTGTTTAACTTGAGTGCAAG<br>AGGGGAGAGTGGAATTCCATGTGTAGCGGTGAAATGCGTAGATATATGGAG<br>GAACACCGGTGGCGAAAGCGGCTCTCTGGCTTGTAACTGACGCTGAGGCTC<br>GAAAGCGTGGGGAGCAAACAGGATTAGATACCCTGGTAGTCCACGCCGTAA<br>ACGATGAGTGCTAGGTGTTAGACCCTTTCCGGGGTTTAGTGCCGAAGCTAAC<br>GCATTAAGCACTCCGCCTGGGGAGTACGACCGCAAGGTTGAAACTCAAAGG<br>AATTGACGGGGGCCCGCACAAGCGGTGGAGCATGTGGTTTAATTCGAAGCA<br>ACGCGAAGAACCTTACCAGGTCTTGACATCCCTCTGACCGCTCTAGAGATAG<br>AGTTTTCCTTCGGGACAGAGGTGACAGGTGGTGCATGGTTGTCGTCAGCTCG<br>TGTCGTGAGATGTTGGGTTAAGTCCCGCAACGAGCGCAACCCCTATTGTTAG<br>TTGCCATCATTYAGTTGGGCACTCTAGCGAGACTGCCGGTAATAAACCGGAG<br>GAAGGTGGGGATGACGTCAAATCATCATGCCCCTTATGACCTGGGCTACAC<br>ACGTGCTACAATGGTTGGTACAACGAGTCGCAAGCCGGTGACGGCAAGCTA<br>ATCTCTTAAAGCCAATCTCAGTTCGGATTGTAGGCTGCAACTCGCCTACATG<br>AAGTCGGAATCGCTAGTAATCGCGGATCAGCACGCCGCGGTGAATACGTTC<br>CCGGGCCTTGTACACACCGCCCGTCACACCACGAGAGTTTGTAAC |
| *Streptococcus_infantis* | SEQ ID NO: 285 | TGCCTAATACATGCAAGTAGAACGCTGAAGGAGGAGCTTGCTCTTCTGGATG<br>AGTTGCGAACGGGTGAGTAACGCGTAGGTAACCTGCCTGGTAGCGGGGGAT<br>AACTATTGGAAACGATAGCTAATACCGCATAACAGTAGATATCGCATGATA<br>GCTGCTTGAAAGGTGCAATTGCACCACTACCAGATGGACCTGCGTTGTATTA<br>GCTAGTTGGTGAGGTAACGGCTCACCAAGGCAACGATACATAGCCGACCTG<br>AGAGGGTGATCGGCCACACTGGGACTGAGACACGGCCCAGACTCCTACGGG<br>AGGCAGCAGTAGGGAATCTTCGGCAATGGACGGAAGTCTGACCGAGCAACG<br>CCGCGTGAGTGAAGAAGGTTTTCGGATCGTAAAGCTCTGTTGTAAGAGAAG<br>AACGAGTGTGAGAGTGGAAAGTTCACACTGTGACGGTATCTTACCAGAAAG<br>GGACGGCTAACTACGTGCCAGCAGCCGCGGTAATACGTAGGTCCCGAGCGT<br>TGTCCGGATTTATTGGGCGTAAAGCGAGCGCAGGCGGTTAGATAAGTCTGA<br>AGTTAAAGGCTGTGGCTTAACCATAGTACGCTTTGGAAACTGTTTAACTTGA<br>GTGCAAGAGGGGAGAGTGGAATTCCATGTGTAGCGGTGAAATGCGTAGATA<br>TATGGAGGAACACCGGTGGCGAAAGCGGCTCTCTGGCTTGTAACTGACGNG<br>AGGCTCGAAAGCGTGGGGAGCAAACAGGATTAGATACCCTGGTAGTCCACG<br>CCGTAAACGATGAGTGCTAGGTGTTAGACCCTTTCCGGGGTTTAGTGCCGTA<br>GCTAACGCATTAAGCACTCCGCCTGGGGAGTACGACCGCAAGGTTGAAACT<br>CAAAGGAATTGACGGGGGCCCGCACAAGCGGTGGAGCATGTGGTTTAATTC<br>GAAGCAACGCGAAGAACCTTACCAGGTCTTGACATCCCTCTGACCGCTCTAG<br>AGATAGAGTTTTCCTTCGGGACAGAGGTGACAGGTGGTGCATGGTTGTCGTC<br>AGCTCGTGTCGTGAGATGTTGGGTTAAGTCCCGCAACGAGCGCAACCCCTAT<br>TGTTAGTTGCCATCATTCAGTTGGGCACTCTAGCGAGACTGCCGGTAATAAA<br>CCGGAGGAAGGTGGGGATGACGTCAAATCATCATGCCCCTTATGACCTGGG<br>CTACACACGTGCTACAATGGTTGGTACAACGAGTCGCAAGCCGGTGACGGC<br>AAGCTAATCTCTTAAAGCCAATCTCAGTTCGGATTGTAGGCTGCAACTCGCC<br>TACATGAAGTCGGAATCGCTAGTAATCGCGGATCAGCACGCCGCGGTGAAT<br>ACG |

TABLE 5-continued

| Full length 16S rDNA sequences of species (negative correlates) | | |
|---|---|---|
| Species Name | Sequence Identifier | 16S rDNA sequence |
| *Streptococcus_infantis* | SEQ ID NO: 286 | GACGAACGCTGGCGGCGTGCCTAATACATGCAAGTAGAACGCTGAAGGAGG<br>AGCTTGCTCTTCTGGATGAGTTGCGAACGGGTGAGTAACGCGTAGGTAACCT<br>GCCTGGTAGCGGGGGATAACTATTGGAAACGATAGCTAATACCGCATAACA<br>GTAGATATCGCATGATAGCTGCTTGAAAGGTGCAATTGCACCACTACCAGAT<br>GGACCTGCGTTGTATTAGCTAGTTGGTGAGGTAACGGCTCACCAAGGCAAC<br>GATACATAGCCGACCTGAGAGGGTGATCGGCCACACTGGGACTGAGACACG<br>GCCCAGACTCCTACGGGAGGCAGCAGTAGGGAATCTTCGGCAATGGACGGA<br>AGTCTGACCGAGCAACGCCGCGTGAGTGAAGAAGGTTTTCGGATCGTAAAG<br>CTCTGTTGTAAGAGAAGAACGAGTGTGAGAGTGGAAAGTTCACACTGTGAC<br>GGTATCTTACCAGAAAGGGACGGCTAACTACGTGCCAGCAGCCGCGGTAAT<br>ACGTAGGTCCCGAGCGTTGTCCGGATTTATTGGGCGTAAAGCGAGCGCAGG<br>CGGTTAGATAAGTCTGAAGTTAAAGGCTGTGGCTTAACCATAGTACGCTTTG<br>GAAACTGTTTAACTTGAGTGCAAGAGGGGAGAGTGGAATTCCATGTGTAGC<br>GGTGAAATGCGTAGATATATGGAGGAACACCGGTGGCGAAAGCGGCTCTCT<br>GGCTTGTAACTGACGCTGAGGCTCGAAAGCGTGGGGAGCAAACAGGATTAG<br>ATACCCTGGTAGTCCACGCCGTAAACGATGAGTGCTAGGTGTTAGACCCTTT<br>CCGGGGTTTAGTGCCGAAGCTAACGCATTAAGCACTCCGCCTGGGGAGTAC<br>GACCGCAAGGTTGAAACTCAAAGGAATTGACGGGGGCCCGCACAAGCGGTG<br>GAGCATGTGGTTTAATTCGAAGCAACGCGAAGAACCTTACCAGGTCTTGAC<br>ATCCCTCTGACCGCTCTAGAGATAGAGTTTTCCTTCGGGACAGAGGTGACAG<br>GTGGTGCATGGTTGTCGTCAGCTCGTGTCGTGAGATGTTGGGTTAAGTCCCG<br>CAACGAGCGCAACCCCTATTGTTAGTTGCCATCATTTAGTTGGGCACTCTAG<br>CGAGACTGCCGGTAATAAACCGGAGGAAGGTGGGGATGACGTCAAATCATC<br>ATGCCCCTTATGACCTGGGCTACACACGTGCTACAATGGTTGGTACAACGAG<br>TCGCAAGCCGGTGACGGCAAGCTAATCTCTTAAAGCCAATCTCAGTTCGGAT<br>TGTAGGCTGCAACTCGCCTACATGAAGTCGGAATCGCTAGTAATCGCGGATC<br>AGCACGCCGCGGTGAATACGTTCCCGGGCCTTGTACACACCGCCCGTCACAC<br>CACGAGAGTTTGTAACACCCGAAGTCGGTGAGGTAACCATTTGGAGCCAGC<br>CGCCTAAGGTGGGATAGATGATT |
| *Clostridium_sp_CL_6* | SEQ ID NO: 287 | GCGATGAAGCCCTTCGGGGTGGATTAGCGGCGGACGGGTGAGTAACACGTG<br>GGTAACCTGCCTTGTAGAGGGGGATAGCCTTCCGAAAGGAAGATTAATACC<br>GCATAACATCTTTTTATCGCATGGTAGAAAGATCAAAGGAGCAATCCGCTAC<br>AAGATGGACCCGCGGCGCATTAGCTAGTTGGTGAGGTAACGGCTCACCAAG<br>GCGACGATGCGTAGCCGACCTGAGAGGGTGATCGGCCACATTGGAACTGAG<br>ACACGGTCCAGACTCCTACGGGAGGCAGCAGTGGGGAATATTGCGCAATGG<br>GGGAAACCCTGACGCAGCAACGCCGCGTGAATGAAGAAGGCCTTAGGGTTG<br>TAAAGTTCTGTTTACGGGGACGATAATGACGGTACCCGTGGGGAAGCCACG<br>GCTAACTACGTGCCAGCAGCCGCGGTAATACGTAGGTGGCAAGCGTTGTCC<br>GGATTTACTGGGCGTAAAGGATGCGTAGGCGGATGTTTAAGTGAGATGTGA<br>AATACCCGGGCTCAACTTGGGTGCTGCATTTCAAACTGGACATCTAGAGTGC<br>GGGAGAGGAAAGCGGAATTCCTAGTGTAGCGGTGAAATGCGTAGAGATTAG<br>GAAGAACACCAGTGGCGAAGGCGGCTTTCTGGACCGTAACTGACGCTGAGG<br>CATGAAAGCGTGGGGAGCAAACAGGATTAGATACCCTGGTAGTCCACGCCG<br>TAAACGATGAATACTAGGTGTAGGAGGTATCGACTCCTTCTGTGCCGCAGTT<br>AACACAATAAGTATTCCGCCTGGGAAGTACGATCGCAAGATTAAAACTCAA<br>AGGAATTGACGGGGGCCCGCACAAGCAGCGGAGCATGTGGTTTAATTCGAA |

TABLE 5-continued

| Full length 16S rDNA sequences of species (negative correlates) | | |
|---|---|---|
| Species Name | Sequence Identifier | 16S rDNA sequence |
| | | GCAACGCGAAGAACCTTACCTAGACTTGACATCTCCTGAATTACTCTTAATC GAGGAAGCCCTTCGGGGCAGGAAGACAGGTGGTGCATGGTTGTCGTCAGCT CGTGTCGTGAGATGTTGGGTTAAGTCCCGCAACGAGCGCAACCCTTATCATT AGTTGCTACCATTAAGTTGAGCACTCTAGTGAGACTGCCACGGTTAACGTGG AGGAAGGTGGGGATGACGTCAAATCATCATGCCCCTTATGTCTAGGGCTAC ACACGTGCTACAATGGTGAATACAAATAGATGCAATACCGCGAGGTGGAGC CAAACTATAAAATTCATCCCAGTTCGGATTGCAGTCTGAAACTCGACTGCAT GAAGCCGGAGTTGCTAGTAATCGCGAATCAGCATGTCGCGGTGAATACGTT CCCGGGCCTTGTACACACCGCCCGTCACACCATGAGAGCTGGTAACACCCG AAGTTCCGTGAGGTAACCGCA |

TABLE 6

Full length 16S rDNA sequences of species (positive correlates)

| Species Name | Sequence Identifier | 16S sequence |
|---|---|---|
| *Streptococcus_mitis_ oralis*_pneumoniae | SEQ ID NO: 288 | aatgagagtttgatcctggctcaggacgaacgctggcggcgtgcctaatacatgcaagtagaacgctgaaggagga gcttgcttctctggatgagagcgaacgggtgagtaacgcgtaggtaacctgcctggtagcgggggataactattgga aacgatagctaataccgcataagagtggatgdgcatgacatttgcttaaaaggtgcacttgcatcactaccagatgga cctgcgttgtattagctagttggtggggtaacggctcaccaaggcgacgatacatagccgacctgagagggtgatcg gccacactgggactgagacacggcccagactcctacgggaggcagcagtagggaatcttcggcaatggacggaa gtctgaccgagcaacgccgcgtgagtgaagaaggattcggatcgtaaagctctgttgtaagagaagaacgagtgtg agagtggaaagttcacactgtgacggtatcttaccagaaagggacggctaactacgtgccagcagccgcggtaata cgtaggtcccgagcgagtccggatttattgggcgtaaagcgagcgcaggcggttagataagtctgaagttaaaggct gtggcttaaccatagtaggattggaaactgataacttgagtgcaagaggggagagtggaattccatgtgtagcggtg aaatgcgtagatatatggaggaacaccggtggcgaaagcggctctctggcttgtaactgacgctgaggctcgaaag cgtggggagcaaacaggattagataccctggtagtccacgctgtaaacgatgagtgctaggtgttagaccctttccgg ggtttagtgccgtagctaacgcattaagcactccgcctggggagtacgaccgcaaggttgaaactcaaaggaattga cgggggcccgcacaagcggtggagcatgtggtttaattcgaagcaacgcgaagaaccttaccaggtcttgacatcc actgaccgctctagagatagagttdcatcgggacagaggtgacaggtggtgcatggttgtcgtcagctcgtgtcgt gagatgttgggttaagtcccgcaacgagcgcaacccctattgttagttgccatcattcagttgggcactctagcgagac tgccggtaataaaccggaggaaggtggggatgacgtcaaatcatcatgccccttatgacctgggctacacacgtgct acaatggctggtacaacgagtcgcaagccggtgacggcaagctaatctcttaaagccagtctcagttcggattgtagg ctgcaactcgcctacatgaagtcggaatcgctagtaatcgcggatcagcacgccgcggtgaatacgttcccgggcct tgtacacaccgcccgtcacaccacgagagtttgtaacacccgaagtcggtgaggtaaccgtaaggagccagccgcc taaggtgggatagatgattggggtgaagtcgtaacaaggtagccgtatcggaaggtgcggctggatcacctcctt |
| *Streptococcus_mitis_ oralis_pneumoniae* | SEQ ID NO: 289 | aatgagagtttgatcctggctcaggacgaacgctggcggcgtgcctaatacatgcaagtagaacgctgaaggagga gcttgcttctctggatgagttgcgaacgggtgagtaacgcgtaggtaacctgcctggtagcgggggataactattgga aacgatagctaataccgcataagagtggatgdgcatgacatttgataaaaggtgcacttgcatcactaccagatgga cctgcgttgtattagctagttggtggggtaacggctcaccaaggcgacgatacatagccgacctgagagggtgatcg gccacactgggactgagacacggcccagactcctacgggaggcagcagtagggaatcttcggcaatggacggaa gtctgaccgagcaacgccgcgtgagtgaagaaggattcggatcgtaaagctctgttgtaagagaagaacgagtgtg agagtggaaagttcacactgtgacggtatcttaccagaaagggacggctaactacgtgccagcagccgcggtaata cgtaggtcccgagcgagtccggatttattgggcgtaaagcgagcgcaggcggttagataagtctgaagttaaaggct gtggcttaaccatagtaggctttggaaactgtttaacttgagtgcaagaggggagagtggaattccatgtgtagcggtg aaatgcgtagatatatggaggaacaccggtggcgaaagcggctctctggcttgtaactgacgctgaggctcgaaag cgtggggagcaaacaggattagataccctggtagtccacgctgtaaacgatgagtgctaggtgttagaccctttccgg ggtttagtgccgtagctaacgcattaagcactccgcctggggagtacgaccgcaaggttgaaactcaaaggaattga cgggggcccgcacaagcggtggagcatgtggtttaattcgaagcaacgcgaagaaccttaccaggtcttgacatcc ctctgaccgctctagagatagagttttccttcgggacagaggtgacaggtggtgcatggttgtcgtcagctcgtgtcgt gagatgttgggttaagtcccgcaacgagcgcaacccctattgttagttgccatcattcagttgggcactctagcgagac tgccggtaataaaccggaggaaggtggggatgacgtcaaatcatcatgccccttatgacctgggctacacacgtgct acaatggctggtacaacgagtcgcaagccggtgacggcaagctaatctcttaaagccagtctcagttcggattgtagg ctgcaactcgcctacatgaagtcggaatcgctagtaatcgcggatcagcacgccgcggtgaatacgttcccgggcct tgtacacaccgcccgtcacaccacgagagtttgtaacacccgaagtcggtgaggtaaccgtaaggagccagccgcc taaggtgggatagatgattggggtgaagtcgtaacaaggtagccgtatcggaaggtgcggctggatcacctcctt |
| *Streptococcus_mitis_ oralis*_pneumoniae | SEQ ID NO: 290 | aatgagagtttgatcctggctcaggacgaacgctggcggcgtgcctaatacatgcaagtagaacgctgaaggagga gcttgcttctctggatgagttgcgaacgggtgagtaacgcgtaggtaacctgcctggtagcgggggataactattgga aacgatagctaataccgcataagagtggatgdgcatgacatttgcttaaaaggtgcacttgcatcactaccagatgga cctgcgttgtattagctagttggtggggtaacggctcaccaaggcgacgatacatagccgacctgagagggtgatcg |

TABLE 6-continued

Full length 16S rDNA sequences of species (positive correlates)

| Species Name | Sequence Identifier | 16S sequence |
|---|---|---|
| | | gccacactgggactgagacacggcccagactcctacgggaggcagcagtagggaatcttcggcaatggacggaa gtctgaccgagcaacgccgcgtgagtgaagaaggattcggatcgtaaagctctgttgtaagagaagaacgagtgtg agagtggaaagttcacactgtgacggtatcttaccagaaagggacggctaactacgtgccagcagccgcggtaata cgtaggtcccgagcgagtccggatttattgggcgtaaagcgagcgcaggcggttagataagtctgaagttaaaggct gtggcttaaccatagtaggctaggaaactgataacttgagtgcaagaggggagagtggaattccatgtgtagcggtg aaatgcgtagatatatggaggaacaccggtggcgaaagcggctctctggcttgtaactgacgctgaggctcgaaag cgtggggagcaaacaggattagataccctggtagtccacgctgtaaacgatgagtgctaggtgttagaccctttccgg ggtttagtgccgtagctaacgcattaagcactccgcctggggagtacgaccgcaaggttgaaactcaaaggaattga cgggggcccgcacaagcggtggagcatgtggtttaattcgaagcaacgcgaagaaccttaccaggtcttgacatcc ctctgaccgctctagagatagagttttccttcgggacagaggtgacaggtggtgcatggttgtcgtcagctcgtgtcgt gagatgttgggttaagtcccgcaacgagcgcaacccctattgttagttgccatcattcagttgggcactctagcgagac tgccggtaataaaccggaggaaggtggggatgacgtcaaatcatcatgccccttatgacctgggctacacacgtgct acaatggctggtacaacgagtcgcaagccggtgacggcaagctaatctcttaaagccagtctcagttcggattgtagg ctgcaactcgcctacatgaagtcggaatcgctagtaatcgcggatcagcacgccgcggtgaatacgttcccgggcct tgtacacaccgcccgtcacaccacgagagtttgtaacacccgaagtcggtgaggtaaccgtaaggagccagccgcc taaggtgggatagatgattggggtgaagtcgtaacaaggtagccgtatcggaaggtgcggctggatcacctcctt |
| *Streptococcus_mitis_ oralis_*pneumoniae | SEQ ID NO: 291 | aatgagagtttgatcctggctcaggacgaacgctggcggcgtgcctaatacatgcaagtagaacgctgaaggagga gcttgcttctctggatgagttgcgaacgggtgagtaacgcgtaggtaacctgcctggtagcgggggataactattgga aacgatagctaataccgcataagagtggatgagcatgacatttgcttaaaaggtgcacttgcatcactaccagatgga cctgcgttgtattagctagttggtggggtaacggctcaccaaggcgacgatacatagccgacctgagagggtgatcg gccacactgggactgagacacggcccagactcctacgggaggcagcagtagggaatcttcggcaatggacggaa gtctgaccgagcaacgccgcgtgagtgaagaaggattcggatcgtaaagactgagtaagagaagaacgagtgtg agagtggaaagttcacactgtgacggtatcttaccagaaagggacggctaactacgtgccagcagccgcggtaata cgtaggtcccgagcgagtccggatttattgggcgtaaagcgagcgcaggcggttagataagtctgaagttaaaggct gtggcttaaccatagtaggctaggaaactgataacttgagtgcaagaggggagagtggaattccatgtgtagcggtg aaatgcgtagatatatggaggaacaccggtggcgaaagcggctctctggcttgtaactgacgctgaggctcgaaag cgtggggagcaaacaggattagataccctggtagtccacgctgtaaacgatgagtgctaggtgttagaccctttccgg ggtttagtgccgtagctaacgcattaagcactccgcctggggagtacgaccgcaaggttgaaactcaaaggaattga cgggggcccgcacaagcggtggagcatgtggtttaattcgaagcaacgcgaagaaccttaccaggtatgacatcc ctctgaccgctctagagatagagttttccttcgggacagaggtgacaggtggtgcatggttgtcgtcagctcgtgtcgt gagatgttgggttaagtcccgcaacgagcgcaacccctattgttagttgccatcattcagttgggcactctagcgagac tgccggtaataaaccggaggaaggtggggatgacgtcaaatcatcatgccccttatgacctgggctacacacgtgct acaatggctggtacaacgagtcgcaagccggtgacggcaagctaatctcttaaagccagtctcagttcggattgtagg ctgcaactcgcctacatgaagtcggaatcgctagtaatcgcggatcagcacgccgcggtgaatacgttcccgggcct tgtacacaccgcccgtcacaccacgagagtttgtaacacccgaagtcggtgaggtaaccgtaaggagccagccgcc taaggtgggatagatgattggggtgaagtcgtaacaaggtagccgtatcggaaggtgcggctggatcacctcctt |
| *Proteus_mirabilis* | SEQ ID NO: 292 | ttgaagagatgatcatggctcagattgaacgctggcggcaggcctaacacatgcaagtcgagcggtaacaggagaa agcttgattatgctgacgagcggcggacgggtgagtaatgtatggggatctgcccgatagagggggataactact ggaaacggtggctaataccgcataatgtctacggaccaaagcaggggctatcggaccttgcactatcggatgaacc catatgggattagctagtaggtggggtaaaggctcacctaggcgacgatctctagctggtctgagaggatgatcagc cacactgggactgagacacggcccagactcctacgggaggcagcagtggggaatattgcacaatgggcgcaagc ctgatgcagccatgccgcgtgtatgaagaaggccttagggagtaaagtactttcagcggggaggaaggtgataagg ttaatacccttgtcaattgacgttacccgcagaagaagcaccggctaactccgtgccagcagccgcggtaatacgga gggtgcaagcgttttatcggaattactgggcgtaaagcgcacgcaggcggtcaattaagtcagatgtgaaagccccg agcttaacttgggaattgcatctgaaactggttggctagagtcttgtagaggggggtagaattccatgtgtagcggtga aatgcgtagagatgtggaggaataccggtggcgaaggcggccccctggacaaagactgacgctcaggtgcgaaa |

TABLE 6-continued

| Full length 16S rDNA sequences of species (positive correlates) | | |
|---|---|---|
| Species Name | Sequence Identifier | 16S sequence |
| | | gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcattagagatagaggagtgctttcgggaacgctgagacaggtgctgcatggctgtcgtcagctcgtgagt<br>gaaatgagggttaagtcccgcaacgagcgcaacccttatcctttgttgccagcacgtaatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |
| *Proteus_mirabilis* | SEQ ID NO: 293 | ttgaagagtttgatcatggctcagattgaacgctggcggcaggcctaacacatgcaagtcgagcggtaacaggagaa<br>agcttgctacttgctgacgagcggcggacgggtgagtaatgtatggggatctgcccgatagaggggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttagggagtaaagtactttcagcggggaggaaggtgataagg<br>ttaataccctttgtcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtcttgtagaggggggtagaattccatgtgtagcggtga<br>aatgcgtagagatgtggaggaataccggtggcgaaggcggcccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcctttagagatagaggagtgccacgggaacgctgagacaggtgctgcatggctgtcgtcagctcgtgagt<br>gaaatgagggttaagtcccgcaacgagcgcaacccttatccatgagccagcacgtgatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctttggttggatcacctcctt |
| *Proteus_mirabilis* | SEQ ID NO: 294 | ttgaagagtagatcatggctcagattgaacgctggcggcaggcctaacacatgcaagtcgagcggtaacaggagaa<br>agcttgctttcttgctgacgagcggcggacgggtgagtaatgtatggggatctgcccgatagaggggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttagggttgtaaagtactttcagcggggaggaaggtgataagg<br>ttaataccctttgtcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtatgtagaggggggtagaattccatgtgtagcggtga<br>aatgcgtagagatgtggaggaataccggtggcgaaggcggcccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatccatagagatagaggagtgccacgggaacgctgagacaggtgctgcatggctgtcgtcagctcgtgttgt<br>gaaatgagggttaagtcccgcaacgagcgcaacccttatcctttgttgccagcacgtaatggtgggaactcaaagga<br>gactgccggtgataaaccggaggaaggtggggatgacgtcaagtcatcatggcccttacgagtagggctacacacg |

TABLE 6-continued

Full length 16S rDNA sequences of species (positive correlates)

| Species Name | Sequence Identifier | 16S sequence |
|---|---|---|
| | | tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |
| *Proteus_mirabilis* | SEQ ID NO: 295 | ttgaagagtttgatcatggctcagattgaacgctggcggcaggcctaacacatgcaagtcgagcggtaacaggagaa<br>agcttgctacttgctgacgagcggcggacgggtgagtaatgtatggggatctgcccgatagagggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttagggagtaaagtactttcagcggggaggaaggtgataagg<br>ttaatacccttatcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtcttgtagaggggggtagaattccatgtgtagcggtga<br>aatgcgtagagatgtggaggaataccggtggcgaaggcggccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcctttagagatagaggagtgccttcgggaacgctgagacaggtgctgcatggctgtcgtcagctcgtgagt<br>gaaatgttgggttaagtcccgcaacgagcgcaacccttatcctttgttgccagcacgtaatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |
| *Proteus_mirabilis* | SEQ ID NO: 296 | ttgaagagtttgatcatggctcagattgaacgctggcggcaggcctaacacatgcaagtcgagcggtaacaggagaa<br>agcttgctttcttgctgacgagcggcggacgggtgagtaatgtatggggatctgcccgatagagggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttaggogtaaagtactttcagcggggaggaaggtgataagg<br>ttaatacccttgtcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtcttgtagaggggggtagaattccatgtgtagcggtga<br>aatgcgtagagatgtggaggaataccggtggcgaaggcggccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcctttagagatagaggagtgccttcgggaacgctgagacaggtgctgcatggctgtcgtcagctcgtgttgt<br>gaaatgttgggttaagtcccgcaacgagcgcaacccttatcctttgttgccagcacgtgatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |

TABLE 6-continued

| Full length 16S rDNA sequences of species (positive correlates) | | |
|---|---|---|
| Species Name | Sequence Identifier | 16S sequence |
| *Proteus_mirabilis* | SEQ ID NO: 297 | ttgaagagtttgatcatggctcagattgaacgctggcggcaggcctaacacatgcaagtcgagcggtaacaggagaa<br>agcttgctttcttgctgacgagcggcggacgggtgagtaatgtatggggatctgcccgatagagggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttagggttgtaaagtactttcagcggggaggaaggtgataagg<br>ttaatacccttatcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtcttgtagaggggggtagaattccatgtgtagcggtga<br>aatgcgtagagatgtggaggaataccggtggcgaaggcggccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcctttagagatagaggagtgccttctggaacgctgagacaggtgctgcatggctgtcgtcagctcgtgttgt<br>gaaatgttgggttaagtcccgcaacgagcgcaacccttatcctttgttgccagcacgtaatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |
| *Proteus_mirabilis* | SEQ ID NO: 298 | ttgaagagtagatcatggctcagattgaacgctggcggcaggcctaacacatgcaagtcgagcggtaacaggagaa<br>agcttgctacttgctgacgagcggcggacgggtgagtaatgtatggggatctgcccgatagagggggataactact<br>ggaaacggtggctaataccgcataatgtctacggaccaaagcaggggctcttcggaccttgcactatcggatgaacc<br>catatgggattagctagtaggtggggtaaaggctcacctaggcgacgatctctagctggtctgagaggatgatcagc<br>cacactgggactgagacacggcccagactcctacgggaggcagcagtggggaatattgcacaatgggcgcaagc<br>ctgatgcagccatgccgcgtgtatgaagaaggccttagggagtaaagtactttcagcggggaggaaggtgataagg<br>ttaatacccttatcaattgacgttacccgcagaagaagcaccggctaactccgtgccagcagccgcggtaatacgga<br>gggtgcaagcgttaatcggaattactgggcgtaaagcgcacgcaggcggtcaattaagtcagatgtgaaagccccg<br>agcttaacttgggaattgcatctgaaactggttggctagagtatgtagaggggggtagaattccatgtgtagcggtga<br>aatgcgtagagatgtggaggaataccggtggcgaaggcggcccccctggacaaagactgacgctcaggtgcgaaa<br>gcgtggggagcaaacaggattagataccctggtagtccacgctgtaaacgatgtcgatttagaggttgtggtcttgaa<br>ccgtggcttctggagctaacgcgttaaatcgaccgcctggggagtacggccgcaaggttaaaactcaaatgaattga<br>cgggggcccgcacaagcggtggagcatgtggtttaattcgatgcaacgcgaagaaccttacctactcttgacatcca<br>gcgaatcctttagagatagaggagtgccttctggaacgctgagacaggtgctgcatggctgtcgtcagctcgtgttgt<br>gaaatgttgggttaagtcccgcaacgagcgcaacccttatccatgagccagcacgtaatggtgggaactcaaagga<br>gactgccggtgataaaccggaggaaggtggggatgacgtcaagtcatcatggcccttacgagtagggctacacacg<br>tgctacaatggcagatacaaagagaagcgacctcgcgagagcaagcggaactcataaagtctgtcgtagtccggatt<br>ggagtctgcaactcgactccatgaagtcggaatcgctagtaatcgtagatcagaatgctacggtgaatacgttcccgg<br>gccttgtacacaccgcccgtcacaccatgggagtgggttgcaaaagaagtaggtagcttaaccttcgggagggcgct<br>taccactttgtgattcatgactggggtgaagtcgtaacaaggtaaccgtaggggaacctgcggttggatcacctcctt |
| *Pediococcus_ acidilactici* | SEQ ID NO: 299 | atgagagtttgatcttggctcaggatgaacgctggcggcgtgcctaatacatgcaagtcgaacgaacttccgttaattg<br>atcaggacgtgcttgcactgaatgagattttaacacgaagtgagtggcggacgggtgagtaacacgtgggtaacctg<br>cccagaagcaggggataacacctggaaacagatgctaataccgtataacagagaaaaccgcctggtatcttttaaaa<br>gatggctctgctatcacttctggatggacccgcggcgcattagctagttggtgaggtaacggctcaccaaggcgatga<br>tgcgtagccgacctgagagggtaatcggccacattgggactgagacacggcccagactcctacgggaggcagca |

TABLE 6-continued

Full length 16S rDNA sequences of species (positive correlates)

| Species Name | Sequence Identifier | 16S sequence |
|---|---|---|
| | | gtagggaatcttccacaatggacgcaagtctgatggagcaacgccgcgtgagtgaagaagggtttcggctcgtaaa gctctgttgttaaagaagaacgtgggtgagagtaactgttcacccagtgacggtatttaaccagaaagccacggctaa ctacgtgccagcagccgcggtaatacgtaggtggcaagcgttatccggatttattgggcgtaaagcgagcgcaggc ggtatttaagtctaatgtgaaagcatcggctcaaccgaagaagtgcattggaaactgggagacttgagtgcagaag aggacagtggaactccatgtgtagcggtgaaatgcgtagatatatggaagaacaccagtggcgaaggcggctgtct ggtctgtaactgacgctgaggctcgaaagcatgggtagcgaacaggattagataccctggtagtccatgccgtaaac gatgattactaagtgaggagggatccgcccttcagtgctgcagctaacgcattaagtaatccgcctggggagtacga ccgcaaggttgaaactcaaaagaattgacgggggcccgcacaagcggtggagcatgtggtttaattcgaagctacg cgaagaaccttaccaggtcttgacatcttctgccaacctaagagattaggcgttcccttcggggacagaatgacaggt ggtgcatggttgtcgtcagctcgtgtcgtgagatgttgggttaagtcccgcaacgagcgcaacccttattactagttgcc agcattcagttgggcactctagtgagactgccggtgacaaaccggaggaaggtggggacgacgtcaaatcatcatg ccccttatgacctgggctacacacgtgctacaatggatggtacaacgagttgcgaaaccgcgaggtttagctaatctct taaaaccattctcagttcggactgtaggctgcaactcgcctacacgaagtcggaatcgctagtaatcgcggatcagca tgccgcggtgaatacgttcccgggccttgtacacaccgcccgtcacaccatgagagtttgtaacacccaaagccggt ggggtaacctttaggagctagccgtctaaggtgggacagatgattagggtgaagtcgtaacaaggtagccgtagga gaacctgcggctggatcacctcctt |
| *Bifidobacterium_ dendum* | SEQ ID NO: 300 | tatggagggttcgattctggctcaggatgaacgctggcggcgtgcttaacacatgcaagtcgaacgggatcccggg ggttcgctcccgggtgagagtggcgaacgggtgagtaatgcgtgaccgacctgccccatacaccggaatagctcct ggaaacgggtggtaatgccggatgctccggttggatgcatgtccttccgggaaagattccatcggtatgggatgggg tcgcgtcctatcagcttgatggcggggtaacggcccaccatggcttcgacgggtagccggcctgagagggcgacc ggccacattgggactgagatacggcccagactcctacgggaggcagcagtggggaatattgcacaatgggcgcaa gcctgatgcagcgacgccgcgtgcgggatggaggccttcgggagtaaaccgctatgatcgggagcaagcccttc ggggtgagtgtacctttcgaataagcaccggctaactacgtgccagcagccgcggtaatacgtagggtgcaagcgtt atccggaattattgggcgtaaagggctcgtaggcggttcgtcgcgtccggtgtgaaagcccatcgcttaacggtgggt ctgcgccgggtacgggcgggctggagtgcggtaggggagactggaattcccggtgtaacggtggaatgtgtagat atcgggaagaacaccaatggcgaaggcaggtctctgggccgtcactgacgctgaggagcgaaagcgtggggagc gaacaggattagataccctggtagtccacgccgtaaacggtggatgctggatgtggggcccgttccacgggttccgt gtcggagctaacgcgttaagcatcccgcctggggagtacggccgcaaggctaaaactcaaagaaattgacggggg cccgcacaagcggcggagcatgcggattaattcgatgcaacgcgaagaaccttacctgggcttgacatgacccgac agccgtagagatatggcctcccttcggggcgggttcacaggtggtgcatggtcgtcgtcagctcgtgtcgtgagatgt tgggttaagtcccgcaacgagcgcaaccctcgccctgtgagccagcacgtcatggtgggaactcacgggggaccg ccggggtcaactcggaggaaggtggggatgacgtcagatcatcatgccccttacgtccagggcttcacgcatgctac aatggccggtacagcgggatgcgacatggcgacatggagcggatccctgaaaaccggtctcagttcggattggagt ctgcaacccgactccatgaaggcggagtcgctagtaatcgcggatcagcaacgccgcggtgaatgcgttcccggg ccagtacacaccgcccgtcaagtcatgaaagtgggcagcacccgaagccggtggcctaaccccttgcgggatgga gccgtctaaggtgaggctcgtgattgggactaagtcgtaacaaggtagccgtaccggaaggtgcggctggatcacct ccttt |
| *Proteus_penneri* | SEQ ID NO: 301 | ttgaagagtttgatcatggctcagattgaacgctggcggcaggcctaacacatgcaagtcgagcggtaacagaagaa agcttgctacttgctgacgagcggcggacgggtgagtaatgtatggggatctgcccgatagagggggagtaactac tggaaacggtggctaataccgcatgacgtctacggaccaaagcaggggctcttcggaccttgcgctatcggatgaac ccatatgggattagctagtaggtgaggtaaaggctcacctaggcgacgatctctagctggtctgagaggatgatcagc cacactgggactgagacacggcccagactcctacgggaggcagcagtggggaatattgcacaatgggcgcaagc ctgatgcagccatgccgcgtgtatgaagaaggccttagggagtaaagtactttcagcggggaggaaggtgataaag ttaatacctttatcaattgacgttacccgcagaagaagcaccggctaactccgtgccagcagccgcggtaatacggag ggtgcaagcgttaatcggaattactgggcgtaaagcgcacgcaggcggtcaattaagtcagatgtgaaagccccga gcttaacttgggaattgcatctgaaactggttggctagagtcagtagagggggtagaattccatctgtagcggtgaa |

TABLE 6-continued

Full length 16S rDNA sequences of species (positive correlates)

| Species Name | Sequence Identifier | 16S sequence |
|---|---|---|
| | | atgcgtagagatgtggaggaataccggtggcgaaggcggcccccctggacaaagactgacgctcaggtgcgaaag cgtggggagcaaacaggattagataccctggtagtccacgctgtaaacgatgtcgatttagaggttgtggtcttgaac cgtggcttctggagctaacgcgttaaatcgaccgcctggggagtacggccgcaaggttaaaactcaaatgaattgac gggggcccgcacaagcggtggagcatgtggtttaattcgatgcaacgcgaagaaccttacctactcttgacatccag cggatcctttagagatagaggagtgccttcgggaacgctgagacaggtgctgcatggctgtcgtcagctcgtgttgtg aaatgttgggttaagtcccgcaacgagcgcaacccttatcctttgttgccagcgcgtgatggcgggaactcaaagga gactgccggtgataaaccggaggaaggtggggatgacgtcaagtcatcatggcccttacgagtagggctacacacg tgctacaatggcagatacaaagagaagcgacctcgcgagagcaagcggaactcataaagtctgtcgtagtccggatt ggagtctgcaactcgactccatgaagtcggaatcgctagtaatcgtagatcagaatgctacggtgaatacgttcccgg gccttgtacacaccgcccgtcacaccatgggagtgggttgcaaaagaagtaggtagcttaaccttcgggagggcgct taccactttgtgattcatgactggggtgaagtcgtaacaaggtaaccgtaggggaacctgcggttggatcacctcctt |
| *Proteus_penneri* | SEQ ID NO: 302 | ttgaagagtttgatcatggctcagattgaacgctggcggcaggcctaacgcatgcaagtcgaccggaaacagagga aagcttgctttcttgctgacgagcggcggacgggtgagtaatgtatggggatctgcccgatagagggggataactatt ggaaaaagggggggtaaataccgcttgacgtctacggccaaaagccggggcgcttcggacctttcgctattggatg aacccatatgggattagctagtaggtgaggtaaaggctcacctaggcgacgatctctagctggtctgagaggatgatc agccacactgggactgagacacggcccagactcctacgggaggcagcagtggggaatattgcacaatgggcgca agcctgatgcagccatgccgcgtgtatgaagaaggccttagggttgtaaagtactttcagcggggaggaaggtgata aagttaatacctttatcaattgacgttacccgcagaagaagcaccggctaactccgtgccagcagccgcggtaatacg gagggtgcaagcgttaatcggaattactgggcgtaaagcgcacgcaggcggtcaattaagtcagatgtgaaagccc cgagcttaacttgggaattgcatctgaaactggttggctagagtcagtagagggggggtagaattccatgtgtagcgg tgaaatgcgtagagatgtggaggaataccggtggcgaaggcggcccccctggacaaagactgacgctcaggtgcga aagcgtggggagcaaacaggattagataccctggtagtccacgctgtaaacgatgtcgatttagaggttgtggtcttg aaccgtggcttctggagctaacgcgttaaatcgaccgcctggggagtacggccgcaaggttaaaactcaaatgaatt gacgggggcccgcacaagcggtggagcatgtggtttaattcgatgcaacgcgaagaaccttacctactcttgacatc cagcgaatcctttagagatagaggagtgccttcgggaacgctgagacaggtgctgcatggctgtcgtcagctcgtgtt gtgaaatgagggttaagtcccgcaacgagcgcaacccttatcctagttgccagcgcgtgatggcgggaactcaaag gagactgccggtgataaaccggaggaaggtggggatgacgtcaagtcatcatggcccttacgagtagggctacaca cgtgctacaatggcagatacaaagagaagcgacctcgcgagagcaagcggaactcataaagtctgtcgtagtccgg attggagtctgcaactcgactccatgaagtcggaatcgctagtaatcgtagatcagaatgctacggtgaatacg |
| *Lactobacillus_ salivarius* | SEQ ID NO: 303 | atgagagtagatcctggctcaggacgaacgctggcggcgtgcctaatacatgcaagtcgaacgaaactttcttacac cgaatgcttgcattcatcgtaagaagttgagtggcggacgggtgagtaacacgtgggtaacctgcctaaaagaaggg gataacacttggaaacaggtgctaataccgtatatctctaaggatcgcatgatccttagatgaaagatggttctgctatc gcttttagatggacccgcggcgtattaactagttggtggggtaacggcctaccaaggtgatgatacgtagccgaactg agaggttgatcggccacattgggactgagacacggcccaaactcctacgggaggcagcagtagggaatcttccaca atggacgcaagtctgatggagcaacgccgcgtgagtgaagaaggtcttcggatcgtaaaactctgttgttagagaag aacacgagtgagagtaactgttcattcgatgacggtatctaaccagcaagtcacggctaactacgtgccagcagccg cggtaatacgtaggtggcaagcgagtccggatttattgggcgtaaagggaacgcaggcggtctataagtctgatgtg aaagccttcggcttaaccggagtagtgcattggaaactggaagacttgagtgcagaagaggagagtggaactccat gtgtagcggtgaaatgcgtagatatatggaagaacaccagtggcgaaagcggctctctggtctgtaactgacgctga ggttcgaaagcgtgggtagcaaacaggattagataccctggtagtccacgccgtaaacgatgaatgctaggtgagg agggtttccgcccttcagtgccgcagctaacgcaataagcattccgcctggggagtacgaccgcaaggttgaaactc aaaggaattgacgggggcccgcacaagcggtggagcatgtggtttaattcgaagcaacgcgaagaaccttaccag gtcttgacatccatgaccacctaagagattaggtttt |

TABLE 6-continued

| Full length 16S rDNA sequences of species (positive correlates) | | |
|---|---|---|
| Species Name | Sequence Identifier | 16S sequence |
| *Veillonella_dispar* | SEQ ID NO: 304 | ttggagagtttgatcctggctcaggacgaacgctggcggcgtgcttaacacatgcaagtcgaacgaagagcgatgg<br>aagcttgcttctatcaatcttagtggcgaacgggtgagtaacgcgtaatcaacctgcccttcagaggggggacaacagt<br>tggaaacgactgctaataccgcatacgatctaacctcggcatcgaggatagatgaaaggtggcctctatttataagcta<br>tcactgaaggaggggattgcgtctgattagctagttggaggggtaacggcccaccaaggcgatgatcagtagccgg<br>tctgagaggatgaacggccacattgggactgagacacggcccagactcctacgggaggcagcagtggggaatctt<br>ccgcaatggacgaaagtctgacggagcaacgccgcgtgagtgatgacggccttcgggttgtaaagctctgttaatcg<br>ggacgaaaggccttcttgcgaatagttagaaggattgacggtaccggaatagaaagccacggctaactacgtgcca<br>gcagccgcggtaatacgtaggtggcaagcgttgtccggaattattgggcgtaaagcgcgcgcaggcggattggtca<br>gtctgtcttaaaagttcggggcttaaccccgtgatgggatggaaactgccaatctagagtatcggagaggaaagtgga<br>attcctagtgtagcggtgaaatgcgtagatattaggaagaacaccagtggcgaaggcgactttctggacgaaaactg<br>acgctgaggcgcgaaagccaggggagcgaacgggattagataccccggtagtcctggccgtaaacgatgggtact<br>aggtgtaggaggtatcgaccccactgtgccggagttaacgcaataagtaccccgcctggggagtacgaccgcaag<br>gttgaaactcaaaggaattgacgggggcccgcacaagcggtggagtatgtggtttaattcgacgcaacgcgaagaa<br>ccttaccaggtcttgacattgatggacagaactagagatagttcctcdcttcggaagccagaaaacaggtggtgcacg<br>gttgtcgtcagctcgtgtcgtgagatgagggttaagtcccgcaacgagcgcaacccctatcttatgagccagcactd<br>gggtgggaactcatgagagactgccgcagacaatgcggaggaaggcggggatgacgtcaaatcatcatgccccctt<br>atgacctgggctacacacgtactacaatgggagttaatagacggaagcaataccgcgaggtggagcaaacccgag<br>aaacactctctcagttcggatcgtaggctgcaactcgcctacgtgaagtcggaatcgctagtaatcgcaggtcagcat<br>actgcggtgaatacgttcccgggccagtacacaccgcccgtcacaccacgaaagtcggaagtgcccaaagccggt<br>ggggtaaccttcgggagccagccgtctaaggtaaagtcgatgattggggtgaagtcgtaacaaggtagccgtatcg<br>gaaggtgcggctggattacctccttt |
| *Veillonella_dispar* | SEQ ID NO: 305 | ttggagagtttgatcctggctcaggacgaacgctggcggcgtgcttaacacatgcaagtcgaacgaagagcgatgg<br>aagcttgcttctatcaatcttagtggcgaacgggtgagtaacgcgtaatcaacctgcccttcagaggggggacaacagt<br>tggaaacgactgctaataccgcatacgatccaatctcggcatcgaggatagatgaaaggtggcctctatttataagcta<br>tcactgaaggaggggattgcgtctgattagctagttggaggggtaacggcccaccaaggcgatgatcagtagccgg<br>tctgagaggatgaacggccacattgggactgagacacggcccagactcctacgggaggcagcagtggggaatctt<br>ccgcaatggacgaaagtctgacggagcaacgccgcgtgagtgatgacggccttcgggttgtaaagctctgttaatcg<br>ggacgaaaggccttcttgcgaatagttagaaggattgacggtaccggaatagaaagccacggctaactacgtgcca<br>gcagccgcggtaatacgtaggtggcaagcgttgtccggaattattgggcgtaaagcgcgcgcaggcggattggtca<br>gtctgtcttaaaagttcggggcttaaccccgtgatgggatggaaactgccaatctagagtatcggagaggaaagtgga<br>attcctagtgtagcggtgaaatgcgtagatattaggaagaacaccagtggcgaaggcgactttctggacgaaaactg<br>acgctgaggcgcgaaagccaggggagcgaacgggattagataccccggtagtcctggccgtaaacgatgggtact<br>aggtgtaggaggtatcgacccccttctgtgccggagttaacgcaataagtaccccgcctggggagtacgaccgcaag<br>gttgaaactcaaaggaattgacgggggcccgcacaagcggtggagtatgtggtttaattcgacgcaacgcgaagaa<br>ccttaccaggtcttgacattgatggacagaactagagatagttcctcttcttcggaagccagaaaacaggtggtgcacg<br>aggttgtcgtcagctcgtgtcgtgatgagggttaagtcccgcaacgagcgcaacccctatcttatgagccagcactd<br>gggtgggaactcatgagagactgccgcagacaatgcggaggaaggcggggatgacgtcaaatcatcatgccccctt<br>atgacctgggctacacacgtactacaatgggagttaatagacggaagcaataccgcgaggtggagcaaacccgag<br>aaacactctctcagttcggatcgtaggctgcaactcgcctacgtgaagtcggaatcgctagtaatcgcaggtcagcat<br>actgcggtgaatacgttcccgggccagtacacaccgcccgtcacaccacgaaagtcggaagtgcccaaagccggt<br>ggggtaaccttcgggagccagccgtctaaggtaaagtcgatgattggggtgaagtcgtaacaaggtagccgtatcg<br>gaaggtgcggctggatcacctccat |

TABLE 6-continued

Full length 16S rDNA sequences of species (positive correlates)

| Species Name | Sequence Identifier | 16S sequence |
|---|---|---|
| *Veillonella_dispar* | SEQ ID NO: 306 | ttggagagtttgatcctggctcaggacgaacgctggcggcgtgcttaacacatgcaagtcgaacgaagagcgatgg<br>aagcttgcactatcaatcttagtggcgaacgggtgagtaacgcgtaatcaacctgcccttcagaggggacaacagt<br>tggaaacgactgctaataccgcatacgatctaacctcggcatcgaggatagatgaaaggtggcctctatttataagcta<br>tcactgaaggaggggattgcgtctgattagctagttggaggggtaacggcccaccaaggcgatgatcagtagccgg<br>tctgagaggatgaacggccacattgggactgagacacggcccagactcctacgggaggcagcagtggggaatat<br>ccgcaatggacgaaagtctgacggagcaacgccgcgtgagtgatgacggccttcgggttgtaaagctctgttaatcg<br>ggacgaaaggccacttgcgaatagttagaaggattgacggtaccggaatagaaagccacggctaactacgtgcca<br>gcagccgcggtaatacgtaggtggcaagcgttgtccggaattattgggcgtaaagcgcgcgcaggcggattggtca<br>gtctgtcttaaaagttcggggcttaaccccgtgatgggatggaaactgccaatctagagtatcggagaggaaagtgga<br>attcctagtgtagcggtgaaatgcgtagatattaggaagaacaccagtggcgaaggcgactttctggacgaaaactg<br>aacgctgaggcgcgaagccaggggagcgaacgggattagataccccggtagtcctggccgtaaacgatgggtact<br>aggtgtaggaggtatcgaccccactgtgccggagttaacgcaataagtaccccgcctggggagtacgaccgcaag<br>gagaaactcaaaggaattgacgggggcccgcacaagcggtggagtatgtggtaaattcgacgcaacgcgaagaa<br>atggacagccttaccaggtcttgacattgaactagagatagacctcttcttcggaagccagaaaacaggtggtgcacg<br>gagtcgtcagctcgtgtcgtgagatgagggttaagtcccgcaacgagcgcaacccctatcttatgagccagcacttt<br>gggtgggaactcatgagagactgccgcagacaatgcggaggaaggcggggatgacgtcaaatcatcatgcccctt<br>atgacctgggctacacacgtactacaatgggagttaatagacggaagcaataccgcgaggtggagcaaacccgag<br>aaacactctctcagttcggatcgtaggctgcaactcgcctacgtgaagtcggaatcgctagtaatcgcaggtcagcat<br>actgcggtgaatacgttcccgggccagtacacaccgcccgtcacaccacgaaagtcggaagtgcccaaagccggt<br>ggggtaaccttcgggagccagccgtctaaggtaaagtcgatgattggggtgaagtcgtaacaaggtagccgtatcg<br>gaaggtgcggctggatcacctccat |
| *Rothia_dentocariosa* | SEQ ID NO: 307 | acggagagtttgattctggctcaggacgaacgctggcggcgtgcttaacacatgcaagtcgaacgatgaagcctagc<br>ttgctaggtggattagtggcgaacgggtgagtaatacgtgagtgacctacctttgactctgggataagcctgggaaact<br>aatctccgcgggtctaataccggatacgaccatggggtgttggtggaaagcgttatggagtggttttagatgggctca<br>cggcctatcagatgaggtgaggtaatggcttaccaaggcgacgacgggtagccggcctgagagggtgaccggcc<br>acactgggactgagacacggcccagactcctacgggaggcagcagtggggaatattgcacaatgggcgcaagcct<br>gatgcagcgacgccgcgtgagggatgacggccttcgggttgtaaacctctgttagcatcgaagaagcgaaagtgac<br>ggtaggtgcagagaaagcgccggctaactacgtgccagcagccgcggtaatacgtagggcgcgagcgttgtccg<br>gaattattgggcgtaaagagcttgtaggcggttggtcgcgtctgctgtgaaaggctggggcttaaccctggtatgcag<br>tgggtacgggctaactagagtgcagtaggggagactggaattcctggtgtagcggtggaatgcgcagatatcagga<br>ggaacaccgatggcgaaggcaggtctctgggctgtaactgacgctgagaagcgaaagcatggggagcgaacagg<br>attagataccctggtagtccatgccgtaaacgagggcactaggtgtgggggacattccacgtatccgcgccgtagct<br>aacgcattaagtgccccgcctggggagtacggccgcaaggctaaaactcaaagaaattgacgggggcccgcacaa<br>gcggcggagcatgcggattaattcgatgcaacgcgaagaaccttaccaaggcttgacatatactggactgcgtcaga<br>gatggcgdtccatcggggctggtatacaggtggtgcatggttgtcgtcagctcgtgtcgtgagatgagggttaagtc<br>ccgcaacgagcgcaaccctcgttctatgttgccagcacgtgatggtggggactcataggagactgccggggtcaact<br>cggaggaaggtggggatgacgtcaaatcatcatgcccatatgtcagggcttcacgcatgctacaatggccggtaca<br>gagggttgcgatactgtgaggtggagctaatccctaaaagccggtctcagttcggattggggtctgcaactcgacccc<br>atgaagtcggagtcgctagtaatcgcagatcagcaacgctgcggtgaatacgttcccgggccttgtacacaccgccc<br>gtcaagtcacgaaagttggtaacacccgaagccggtggcctaaccctggtgggggagccgtcgaaggtgggact<br>ggcgattgggactaagtcgtaacaaggtagccgtaccggaaggtgcggctggatcacctcatt |
| *Rothia_dentocariosa* | SEQ ID NO: 308 | acggagagtttgattctggctcaggacgaacgctggcggcgtgcttaacacatgcaagtcgaacgatgaagcctagc<br>ttgctaggtggattagtggcgaacgggtgagtaatacgtgagtgacctacctttgactctgggataagcctgggaaact<br>aatctccgcgggtctaataccggatacgaccatggggtgttggtggaaagcgttatggagtggttttagatgggctca<br>cggcctatcagcttgaggtgaggtaatggcttaccaaggcgacgacgggtagccggcctgagagggtgaccggcc |

TABLE 6-continued

Full length 16S rDNA sequences of species (positive correlates)

| Species Name | Sequence Identifier | 16S sequence |
| --- | --- | --- |
| | | acactgggactgagacacggcccagactcctacgggaggcagcagtggggaatattgcacaatgggcgcaagcct<br>gatgcagcgacgccgcgtgagggatgacggccttcgggttgtaaacctctgttagcatcgaagaagcgaaagtgac<br>ggtaggtgcagagaaagcgccggctaactacgtgccagcagccgcggtaatacgtagggcgcgagcgttgtccg<br>gaattattgggcgtaaagagcttgtaggcggttggtcgcgtctgctgtgaaaggctggggcttaaccctggtatgcag<br>tgggtacgggctaactagagtgcagtaggggagactggaattcctggtgtagcggtggaatgcgcagatatcagga<br>ggaacaccgatggcgaaggcaggtctctgggctgtaactgacgctgagaagcgaaagcatggggagcgaacagg<br>attagataccctggtagtccatgccgtaaacgttgggcactaggtgtgggggacattccacgtatccgcgccgtagct<br>aacgcattaagtgccccgcctggggagtacggccgcaaggctaaaactcaaagaaattgacgggggcccgcacaa<br>gcggcggagcatgcggattaattcgatgcaacgcgaagaaccttaccaaggcttgacatatactggactgcgtcaga<br>gatggcgdtccatcggggctggtatacaggtggtgcatggttgtcgtcagctcgtgtcgtgagatgttgggttaagtc<br>ccgcaacgagcgcaaccctcgttctatgttgccagcacgtgatggtggggactcataggagactgccggggtcaact<br>cggaggaaggtggggatgacgtcaaatcatcatgccccttatgtcagggatcacgcatgctacaatggccggtaca<br>gagggttgcgatactgtgaggtggagctaatccctaaaagccggtctcagttcggattggggtctgcaactcgacccc<br>atgaagtcggagtcgctagtaatcgcagatcagcaacgctgcggtgaatacgttcccgggccttgtacacaccgccc<br>gtcaagtcacgaaagttggtaacacccgaagccggtggcctaaccctggtgggggagccgtcgaaggtgggact<br>ggcgattgggactaagtcgtaacaaggtagccgtaccggaaggtgcggctggatcacctccttt |
| *Rothia_dentocariosa* | SEQ ID NO: 309 | acggagagtttgattctggctcaggacgaacgctggcggcgtgcttaacacatgcaagtcgaacgatgaagcctagc<br>ttgctaggtggattagtggcgaacgggtgagtaatacgtgagtgacctacctttgactctgggataagcctgggaaact<br>gggtctaataccggatacgaccaatctccgcatggggtgttggtggaaagcgttatggagtggttttagatgggctca<br>cggcctatcagcttgttggtgaggtaatggcttaccaaggcgacgacgggtagccggcctgagagggtgaccggcc<br>acactgggactgagacacggcccagactcctacgggaggcagcagtggggaatattgcacaatgggcgcaagcct<br>gatgcagcgacgccgcgtgagggatgacggccttcgggttgtaaacctctgttagcatcgaagaagcgaaagtgac<br>ggtaggtgcagagaaagcgccggctaactacgtgccagcagccgcggtaatacgtagggcgcgagcgttgtccg<br>gaattattgggcgtaaagagcttgtaggcggttggtcgcgtctgctgtgaaaggctggggcttaaccctggtatgcag<br>tgggtacgggctaactagagtgcagtaggggagactggaattcctggtgtagcggtggaatgcgcagatatcagga<br>ggaacaccgatggcgaaggcaggtctctgggctgtaactgacgctgagaagcgaaagcatggggagcgaacagg<br>attagataccctggtagtccatgccgtaaacgagggcactaggtgtgggggacattccacgttttccgcgccgtagct<br>aacgcattaagtgccccgcctggggagtacggccgcaaggctaaaactcaaagaaattgacgggggcccgcacaa<br>gcggcggagcatgcggattaattcgatgcaacgcgaagaaccttaccaaggcttgacatatactggactgcgtcaga<br>gatggcgtttcccttcggggctggtatacaggtggtgcatggttgtcgtcagctcgtgtcgtgagatgttgggttaagtc<br>ccgcaacgagcgcaaccctcgttctatgagccagcacgtgatggtggggactcataggagactgccggggtcaact<br>cggaggaaggtggggatgacgtcaaatcatcatgccccttatgtcagggcttcacgcatgctacaatggccggtaca<br>gagggttgcgatactgtgaggtggagctaatccctaaaagccggtctcagttcggattggggtctgcaactcgacccc<br>atgaagtcggagtcgctagtaatcgcagatcagcaacgctgcggtgaatacgttcccgggccttgtacacaccgccc<br>gtcaagtcacgaaagttggtaacacccgaagccggtggcctaaccctggtgggggagccgtcgaaggtgggact<br>ggcgattgggactaagtcgtaacaaggtagccgtaccggaaggtgcggctggatcacctccttt |
| *Megasphaera_ micronuciformis* | SEQ ID NO: 310 | atggagagtttgatcctggctcaggacgaacgctggcggcgtgcttaacacatgcaagtcgaacgagagcgtagag<br>aaagcttgctddctacaatctagtggcaaacgggtgagtaacgcgtaaacaacctgccctacggatggggacaaca<br>gctggaaacggctgctaataccgaatacgttccgaaagtcgcatgactgtcggaagaaaggatggcctctatttataa<br>gctatcgccggaggaggggtttgcgtctgattagctagttggaggggtaacggcccaccaaggcgacgatcagtag<br>ccggtctgagaggatgaacggccacattggaactgagacacggtccagactcctacgggaggcagcagtgggga<br>atcttccgcaatgggcgaaagcctgacggagcaacgccgcgtgagtgaagacggccttcgggttgtaaagctctgtt<br>atacgggacgaataatcttgtggttaatacccataagaagtgacggtaccgtaagagaaagccacggctaactacgt<br>gccagcagccgcggtaatacgtaggtggcaagcgttgtccggaattattgggcgtaaagggcgcgcaggcggcttc<br>ttaagtctgtcttaaaagtgcggggcttaaccccgtgatgggatggaaactgggaagctcagagtatcggagaggaa<br>agcggaattcctagtgtagcggtgaaatgcgtagatattaggaggaacaccagtggcgaaagcggctdctggacga |

TABLE 6-continued

Full length 16S rDNA sequences of species (positive correlates)

| Species Name | Sequence Identifier | 16S sequence |
|---|---|---|
| | | aaactgacgctgaggcgcgaaagccaggggagcgaacgggattagataccccggtagtcctggccgtaaacgat gggtactaggtgtaggaggtatcgaccccttctgtgccggagttaacgcaataagtaccccgcctggggagtacggc cgcaaggagaaactcaaaggaattgacgggggcccgcacaagcggtggagtatgtggataattcgacgcaacgc gaagaaccttaccaagccttgacattgatcgcaaggagtagagatactctgttcacttcggaagacgagaaaacagg tggtgcacggctgtcgtcagctcgtgtcgtgagatgttgggttaagtcccgcaacgagcgcaacccctatcttctgtta ccagcacgtaacggtggggactcaggagagactgccgcagacaatgcggaggaaggcggggatgacgtcaagt catcatgccccttatggcttgggctacacacgtactacaatggctcttaatagagggaggcgaaggagcgatccgga gcaaaccccaaaaacagagtctcagttcggattgtaggctgcaactcgcctacatgaagcaggaatcgctagtaatc gcaggtcagcatactgcggtgaatacgttcccgggccttgtacacaccgcccgtcacaccacgaaagtcattcacac ccgaagccggtgaggtaaccgcaaggagccagccgtcgaaggtgggggcgatgattggggtgaagtcgtaacaa ggtagccgtatcggaaggtgcggctgg |
| *Veillonella_atypica* | SEQ ID NO: 311 | ttggagagtttgatcctggctcaggacgaacgctggcggcgtgcttaacacatgcaagtcgaacgaagagcgatgg aagcttgcactatcaatcttagtggcgaacgggtgagtaacgcgtaatcaacctgcccttcagagggggacaacagt tggaaacgactgctaataccgcatacgatccaatctcggcatcgagactggatgaaaggtggcctctatttataagcta tcactgaaggaggggattgcgtctgattagctagttggaggggtaacggcccaccaaggcgatgatcagtagccgg tctgagaggatgaacggccacattgggactgagacacggcccagactcctacgggaggcagcagtggggaatat ccgcaatggacgaaagtctgacggagcaacgccgcgtgagtgatgacggccttcgggttgtaaagctctgttaatcg ggacgaatggttcttgtgcgaatagtgcgaggatttgacggtaccggaatagaaagccacggctaactacgtgccag cagccgcggtaatacgtaggtggcaagcgttgtccggaattattgggcgtaaagcgcgcgcaggcggattagttagt ctgtataaaagttcggggcttaaccccgtgatgggatggaaactgctgatctagagtatcggagaggaaagtggaat tcctagtgtagcggtgaaatgcgtagatattaggaagaacaccagtggcgaaggcgactttctggacgaaaactgac gctgaggcgcgaaagccaggggagcgaacgggattagataccccggtagtcctggccgtaaacgatgggtactag gtgtaggaggtatcgaccccactgtgccggagttaacgcaataagtaccccgcctggggagtacgaccgcaaggtt gaaactcaaaggaattgacgggggcccgcacaagcggtggagtatgtggtttaattcgacgcaacgcgaagaacct taccaggtcttgacattgatggacagaactagagatagttcctatcttcggaagccagaaaacaggtggtgcacggtt gtcgtcagctcgtgtcgtgagatgttgggttaagtcccgcaacgagcgcaacccctatcttatgttgccagcacttcgg gtgggaactcatgagagactgccgcagacaatgcggaggaaggcggggatgacgtcaaatcatcatgccccttatg acctgggctacacacgtactacaatgggagttaatagacggaagcgaaaccgcgaggtggagcaaacccgagaaa cactctctcagttcggatcgtaggctgcaactcgcctacgtgaagtcggaatcgctagtaatcgcaggtcagcatactg cggtgaatacgacccgggccagtacacaccgcccgtcacaccacgaaagtcggaagtgcccaaagccggtggg gtaaccttcgggagccagccgtctaaggtaaagtcgatgattggggtgaagtcgtaacaaggtagccgtatcggaag gtgcggctggatcacctccat |
| *Streptococcus_ thermophilus* | SEQ ID NO: 312 | aatgagagtttgatcctggctcaggacgaacgctggcggcgtgcctaatacatgcaagtagaacgctgaagagagg agcttgctatcttggatgagttgcgaacgggtgagtaacgcgtaggtaacctgccagtagcgggggataactattgg aaacgatagctaataccgcataacaatggatgacacatgtcatttatttgaaaggggcaattgctccactacaagatgg acctgcgttgtattagctagtaggtgaggtaatggctcacctaggcgacgatacatagccgacctgagagggtgatcg gccacactgggactgagacacggcccagactcctacgggaggcagcagtagggaatcttcggcaatgggggcaa ccctgaccgagcaacgccgcgtgagtgaagaaggttttcggatcgtaaagctctgttgtaagtcaagaacgggtgtg agagtggaaagttcacactgtgacggtagcttaccagaaagggacggctaactacgtgccagcagccgcggtaata cgtaggtcccgagcgagtccggatttattgggcgtaaagcgagcgcaggcgggttgataagtctgaagttaaaggct ggggctcaaccatagttcgctttggaaactgtcaaacttgagtgcagaaggggagagtggaattccatgtgtagcggt gaaatgcgtagatatatggaggaacaccggtggcgaaagcggctctctggtctgtaactgacgctgaggctcgaaa gcgtggggagcgaacaggattagataccctggtagtccacgccgtaaacgatgagtgctaggtgttggatcctttcc gggattcagtgccgaagctaacgcattaagcactccgcctggggagtacgaccgcaaggttgaaactcaaaggaat tgacgggggcccgcacaagcggtggagcatgtggtttaattcgaagcaacgcgaagaaccttaccaggtcttgacat cccgatgctatttctagagatagaaagttacttcggtacatcggtgacaggtggtgcatggttgtcgtcagctcgtgtcg |

TABLE 6-continued

| Full length 16S rDNA sequences of species (positive correlates) | | |
|---|---|---|
| Species Name | Sequence Identifier | 16S sequence |
| | | tgagatgttgggttaagtcccgcaacgagcgcaacccctattgttagagccatcattcagttgggcactctagcgaga ctgccggtaataaaccggaggaaggtggggatgacgtcaaatcatcatgccccttatgacctgggctacacacgtgc tacaatggttggtacaacgagttgcgagtcggtgacggcgagctaatctcttaaagccaatctcagttcggattgtagg ctgcaactcgcctacatgaagtcggaatcgctagtaatcgcggatcagcacgccgcggtgaatacgttcccgggcct tgtacacaccgcccgtcacaccacgagagtttgtaacacccgaagtcggtgaggtaaccattggagccagccgcct aaggtgggacagatgattggggtgaagtcgtaacaaggtagccgtatcggaaggtgcggctgggtcacctcctt |
| *Streptococcus_ thermophilus* | SEQ ID NO: 313 | atgaaagtttgatcctggctcaggacgaacgctggcggcgtgcctaatacatgcaagtagaacgctgaagagaggag cttgctcacttggatgagttgcgaacgggtgagtaacgcgtaggtaacctgccttgtagcgggggataactattggaaa cgatagctaataccgcataacaatggatgacacatgtcatttatttgaaaggggcaattgctccactacaagatggacctg cgttgtattagctagtaggtgaggtaatggctcacctaggcgacgatacatagccgacctgagagggtgatcggccac actgggactgagacacggcccagactcctacgggaggcagcagtagggaatcacggcaatgggggcaaccctgac cgagcaacgccgcgtgagtgaagaaggttttcggatcgtaaagctctgagtaagtcaagaacgggtgtgagagtgga aagttcacactgtgacggtagcttaccagaaagggacggctaactacgtgccagcagccgcggtaatacgtaggtccc gagcgttgtccggatttattgggcgtaaagcgagcgcaggcggtttgataagtctgaagttaaaggctgtggctcaacc atagttcgctttggaaactgtcaaacttgagtgcagaaggggagagtggaattccatgtgtagcggtgaaatgcgtagat atatggaggaacaccggtggcgaaagcggctcactggtctgtaactgacgctgaggctcgaaagcgtggggagcga acaggattagataccctggtagtccacgccgtaaacgatgagtgctaggtgttggatcctttccgggattcagtgccgca gctaacgcattaagcactccgcctggggagtacgaccgcaaggttgaaactcaaaggaattgacgggggcccgcac aagcggtggagcatgtggtttaattcgaagcaacgcgaagaaccttaccaggtcttgacatcccgatgctatactagag atagaaagttacttcggtacatcggtgacaggtggtgcatggttgtcgtcagctcgtgtcgtgagatgttgggttaagtcc cgcaacgagcgcaacccctattgttagttgccatcattcagttgggcactctagcgagactgccggtaataaaccggag gaaggtggggatgacgtcaaatcatcatgccccttatgacctgggctacacacgtgctacaatggttggtacaacgagtt gcgagtcggtgacggcgagctaatctcttaaagccaatctcagttcggattgtaggctgcaactcgcctacatgaagtcg gaatcgctagtaatcgcggatcagcacgccgcggtgaatacgttcccgggccttgtacacaccgcccgtcacaccacg agagatgtaacacccgaagtcggtgaggtaaccattggagccagccgcctaaggtgggacagatgattggggtgaa gtcgtaacaaggtagccgtatcggaaggtgcggctggatcacctcctt |
| *Streptococcus_ thermophilus* | SEQ ID NO: 314 | aatgagagtagatcctggctcaggacgaacgctggcggcgtgcctaatacatgcaagtagaacgctgaagagagga gcttgctcttcttggatgagttgcgaacgggtgagtaacgcgtaggtaacctgccttgtagcgggggataactattggaa acgatagctaataccgcataacaatggatgacacatgtcatttatttgaaaggggcaattgctccactacaagatggacct gcgttgtattagctagtaggtgaggtaatggctcacctaggcgacgatacatagccgacctgagagggtgatcggcca cactgggactgagacacggcccagactcctacgggaggcagcagtagggaatcttcggcaatgggggcaaccctga ccgagcaacgccgcgtgagtgaagaaggttttcggatcgtaaagctctgttgtaagtcaagaacgggtgtgagagtgg aaagttcacactgtgacggtagcttaccagaaagggacggctaactacgtgccagcagccgcggtaatacgtaggtcc cgagcgttgtccggatttattgggcgtaaagcgagcgcaggcggtttgataagtctgaagttaaaggctgtggctcaac catagttcgctttggaaactgtcaaacttgagtgcagaaggggagagtggaattccatgtgtagcggtgaaatgcgtag atatatggaggaacaccggtggcgaaagcggctctctggtctgtaactgacgctgaggctcgaaagcgtggggagcg aacaggattagataccctggtagtccacgccgtaaacgatgagtgctaggtgttggatcctttccgggattcagtgccgc agctaacgcattaagcactccgcctggggagtacgaccgcaaggttgaaactcaaaggaattgacgggggcccgca caagcggtggagcatgtggtttaattcgaagcaacgcgaagaaccttaccaggtatgacatcccgatgctatttctaga gatagaaagttacttcggtacatcggtgacaggtggtgcatggttgtcgtcagctcgtgtcgtgagatgttgggttaagtc ccgcaacgagcgcaacccctattgttagagccatcattcagttgggcactctagcgagactgccggtaataaaccgga ggaaggtggggatgacgtcaaatcatcatgccccttatgacctgggctacacacgtgctacaatggttggtacaacgag ttgcgagtcggtgacggcgagctaatctcttaaagccaatctcagttcggattgtaggctgcaactcgcctacatgaagt cggaatcgctagtaatcgcggatcagcacgccgcggtgaatacgacccgggccagtacacaccgcccgtcacacca cgagagtttgtaacacccgaagtcggtgaggtaaccttttggagccagccgcctaaggtgggacagatgattggggtg aagtcgtaacaaggtagccgtatcggaaggtgcggctggatcacctcctt |

TABLE 6-continued

Full length 16S rDNA sequences of species (positive correlates)

| Species Name | Sequence Identifier | 16S sequence |
|---|---|---|
| *Streptococcus_ thermophilus* | SEQ ID NO: 315 | aatgagagtttgatcctggctcaggacgaacgctggcggcgtgcctaatacatgcaagtagaacgctgaagagagga gcttgctcttcttggatgagttgcgaacgggtgagtaacgcgtaggtaacctgccttgtagcgggggataactattggaa acgatagctaataccgcataacaatggatgacacatgtcatttatttgaaaggggcaattgctccactacaagatggacct gcgttgtattagctagtaggtgaggtaatggctcacctaggcgacgatacatagccgacctgagagggtgatcggcca cactgggactgagacacggcccagactcctacgggaggcagcagtagggaatcttcggcaatgggggcaaccctga ccgagcaacgccgcgtgagtgaagaaggttttcggatcgtaaagctctgttgtaagtcaagaacgggtgtgagagtgg aaagttcacactgtgacggtagcttaccagaaagggacggctaactacgtgccagcagccgcggtaatacgtaggtcc cgagcgttgtccggatttattgggcgtaaagcgagcgcaggcgggttgataagtctgaagttaaaggctggggctcaa ccatagttcgctttggaaactgtcaaacttgagtgcagaaggggagagtggaattccatgtgtagcggtgaaatgcgta gatatatggaggaacaccggtggcgaaagcggctctctggtctgtaactgacgctgaggctcgaaagcgtggggagc gaacaggattagataccctggtagtccacgccgtaaacgatgagtgctaggtgaggatcctttccgggattcagtgccg cagctaacgcattaagcactccgcctggggagtacgaccgcaaggttgaaactcaaaggaattgacgggggcccgc acaagcggtggagcatgtggtttaattcgaagcaacgcgaagaaccttaccaggtatgacatcccgatgctatttctag agatagaaagttacttcggtacatcggtgacaggtggtgcatggttgtcgtcagctcgtgtcgtgagatgttgggttaagt cccgcaacgagcgcaacccctattgttagttgccatcattcagttgggcactctagcgagactgccggtaataaaccgg aggaaggtggggatgacgtcaaatcatcatgcccatatgacctgggctacacacgtgctacaatggttggtacaacga gttgcgagtcggtgacggcgagctaatctcttaaagccaatctcagttcggattgtaggctgcaactcgcctacatgaag tcggaatcgctagtaatcgcggatcagcacgccgcggtgaatacgttcccgggccttgtacacaccgcccgtcacacc acgagagtttgtaacacccgaagtcggtgaggtaaccattggagccagccgcctaaggtgggacagatgattggggt gaagtcgtaacaaggtagccgtatcggaaggtgcggctggtcacctcctt |
| *Streptococcus_ thermophilus* | SEQ ID NO: 316 | aatgagagtttgatcctggctcaggacgaacgctggcggcgtgcctaatacatgcaagtagaacgctgaagagagga gcttgctcttcttggatgagttgcgaacgggtgagtaacgcgtaggtaacctgccttgtagcgggggataactattggaa acgatagctaataccgcataacaatggatgacacatgtcatttatttgaaaggggcaattgctccactacaagatggacct gcgttgtattagctagtaggtgaggtaatggctcacctaggcgacgatacatagccgacctgagagggtgatcggcca cactgggactgagacacggcccagactcctacgggaggcagcagtagggaatcttcggcaatgggggcaaccctga ccgagcaacgccgcgtgagtgaagaaggttttcggatcgtaaagctctgttgtaagtcaagaacgggtgtgagagtgg aaagttcacactgtgacggtagcttaccagaaagggacggctaactacgtgccagcagccgcggtaatacgtaggtcc cgagcgttgtccggatttattgggcgtaaagcgagcgcaggcgggttgataagtctgaagttaaaggctgtggctcaac catagttcgattggaaactgtcaaacttgagtgcagaaggggagagtggaattccatgtgtagcggtgaaatgcgtag atatatggaggaacaccggtggcgaaagcggctctctggtctgtaactgacgctgaggctcgaaagcgtggggagcg aacaggattagataccctggtagtccacgccgtaaacgatgagtgctaggtgttggatcctttccgggattcagtgccgc agctaacgcattaagcactccgcctggggagtacgaccgcaaggttgaaactcaaaggaattgacgggggcccgca caagcggtggagcatgtggtttaattcgaagcaacgcgaagaaccttaccaggtatgacatcccgatgctatttctaga gatagaaagttacttcggtacatcggtgacaggtgggcatggttgtcgtcagctcgtgtcgtgagatgttgggttaagtcc cgcaacgagcgcaacccctattgttagttgccatcattcagagggcactctagcgagactgccggtaataaaccggag gaaggtggggatgacgtcaaatcatcatgccccttatgacctgggctacacacgtgctacaatggttggtacaacgagtt gcgagtcggtgacggcgagctaatctcttaaagccaatctcagttcggattgtaggctgcaactcgcctacatgaagtcg gaatcgctagtaatcgcggatcagcacgccgcggtgaatacgttcccgggccagtacacaccgcccgtcacaccacg agagtttgtaacacccgaagtcggtgaggtaaccattggagccagccgcctaaggtgggacagatgattggggtgaa gtcgtaacaaggtagccgtatcggaaggtgcggctgggtcacctcctt |
| *Lactobacillus_ animalis* | SEQ ID NO: 317 | attgagagatgatcctggctcaggatgaacgctggcggcgtgcctaatacatgcaagtcgaacgaaacttcatatcacc gagtgcttgcactcaccgataaagagttgagtggcgaacgggtgagtaacacgtgggcaacctgcccaaaagaggg ggataacacttggaaacaggtgctaataccgcataaccatagttaccgcatggtaactatgtaaaaggtggctatgctac cgcttttggatgggcccgcggcgcattagctagttggtgaggtaaaggcttaccaaggcaatgatgcgtagccgaactg agaggagatcggccacattgggactgagacacggcccaaactcctacgggaggcagcagtagggaatcaccacaa |

TABLE 6-continued

Full length 16S rDNA sequences of species (positive correlates)

| Species Name | Sequence Identifier | 16S sequence |
|---|---|---|
| | | tgggcgaaagcctgatggagcaacgccgcgtgggtgaagaaggtcttcggatcgtaaaaccctgagttagagaaga<br>aagtgcgtgagagtaactgttcacgatcgacggtatctaaccagaaagccacggctaactacgtgccagcagccgcg<br>gtaatacgtaggtggcaagcgttatccggatttattgggcgtaaagggaacgcaggcggtcdttaagtctgatgtgaaa<br>gccttcggcttaaccggagtagtgcattggaaactgggagacttgagtgcagaagaggagagtggaactccatgtgta<br>gcggtgaaatgcgtagatatatggaagaacaccagtggcgaaagcggctctctggtctgtaactgacgctgaggdcg<br>aaagcgtgggtagcaaacaggattagataccctggtagtccacgccgtaaacgatgaatgctaagtgttggagggtttc<br>cgcccttcagtgctgcagctaacgcaataagcattccgcctggggagtacgaccgcaaggttgaaactcaaaggaatt<br>gacgggggcccgcacaagcggtggagcatgtggtttaattcgaagcaacgcgaagaaccttaccaggtatgacatct<br>tctgacaatcctagagataggactttcccttcggggacagaatgacaggtggtgcatggagtcgtcagacgtgtcgtg<br>agatgttgggttaagtcccgcaacgagcgcaacccttattgttagttgccagcattaagttgggcactctagcaagactg<br>ccggtgacaaaccggaggaaggtggggatgacgtcaaatcatcatgccccttatgacctgggctacacacgtgctaca<br>atggacggtacaacgagtcgcaagaccgcgaggtttagcaaatctcttaaagccgttctcagttcggattgtaggctgca<br>actcgcctacatgaagtcggaatcgctagtaatcgcggatcagcatgccgcggtgaatacgttcccgggccttgtacac<br>accgcccgtcacaccatgagagtttgtaacacccaaagccggtggggtaacctttggagccagccgtctaaggtggg<br>acagatgattggggtgaagtcgtaacaaggtagccgtaggagaacctgcggctggatcacctccttt |
| *Bilophila_ wadsworthia* | SEQ ID NO: 318 | ctggagagtttgattctggctcagattgaacgctggcggcgtgcttaacacatgcaagtcgaacgtgaaagtccttcggg<br>gcgagtaaagtggcgcacgggtgagtaacgcgtggataatctacccttaagatggggataacggctggaaacggtcg<br>ctaataccgaatacgctcccgattttatcattgggggaaagatggcctctgcttgcaagctatcgcttaaggatgagtcc<br>gcgtcccattagctagaggcggggtaacggcccaccaaggcgacgatgggtagccggtctgagaggatgaccggc<br>cacactggaactggaacacggtccagactcctacgggaggcagcagtggggaatattgcgcaatgggcgaaagcct<br>gacgcagcgacgccgcgtgagggatgaaggttctcggatcgtaaacctctgtcagggggaagaaacccctcgtgt<br>gaataatgcgagggcttgacggtacccccaaaggaagcaccggctaactccgtgccagcagccgcggtaatacgga<br>gggtgcaagcgttaatcggaatcactgggcgtaaagcgcacgtaggcggcaggtaagtcaggggtgaaatcccaca<br>gcccaactgtggaactgcctttgatactgccaggcttgagtaccggagagggtggcggaattccaggtgtaggagtga<br>aatccgtagatatctggaggaacaccggtggcgaaggcggccacctggacggtaactgacgctgaggtgcgaaagc<br>gtgggtagcaaacaggattagataccctggtagtccacgctgtaaacgatgggtgctgggtgctgggatgtatgtctcg<br>gtgccgtagctaacgcgataagcaccccgcctggggagtacggtcgcaaggctgaaactcaaagaaattgacgggg<br>gcccgcacaagcggtggagtatgtggtttaattcgatgcaacgcgaagaaccttacccaggcttgacatctagggaac<br>ccttcggaaatgaaggggtgcccttcggggagccctaagacaggtgctgcatggctgtcgtcagctcgtgccgtgagg<br>tgttgggttaagtcccgcaacgagcgcaacccctatcttcagttgccagcaggtaaggctgggcactctggagagacc<br>gccccggtcaacggggaggaaggtggggacgacgtcaagtcatcatggcccttacgcctggggctacacacgtact<br>acaatggcgcgcacaaagggtagcgagaccgcgaggtggagccaatcccaaaaaacgcgtcccagtccggattgg<br>agtctgcaactcgactccatgaagtcggaatcgctagtaattcgagatcagcatgctcgggtgaatgcgttcccgggcct<br>tgtacacaccgcccgtcacaccacgaaagtcggattacccgaagccggtgagctaactcgcaagaggagcagccgt<br>ctacggtagggccgatgattggggtgaagtcgtaacaaggtagccgtaggggaacctgcggctggatcacctccttt |
| *Bilophila_ wadsworthia* | SEQ ID NO: 319 | ctggagagtttgattctggctcagattgaacgctggcggcgtgcttaacacatgcaagtcgaacgtgaaagtccttcggg<br>gcgagtaaagtggcgcacgggtgagtaacgcgtggataatctacccttaagatggggataacggctggaaacggtcg<br>ctaataccgaatacgctcccgattttatcgttgggggaaagatggcctctgcttgcaagctatcgcttaaggatgagtcc<br>gcgtcccattagctagaggcggggtaacggcccaccaaggcgacgatgggtagccggtctgagaggatgaccggc<br>cacactggaactggaacacggtccagactcctacgggaggcagcagtggggaatattgcgcaatgggcgaaagcct<br>gacgcagcgacgccgcgtgagggatgaaggactcggatcgtaaacctctgtcagggggaagaaacccctcgtgt<br>gaataatgcgagggcttgacggtacccccaaaggaagcaccggctaactccgtgccagcagccgcggtaatacgga<br>gggtgcaagcgttaatcggaatcactgggcgtaaagcgcacgtaggcggcttggtaagtcaggggtgaaatcccaca<br>gcccaactgtggaactgcctttgatactgccaggcttgagtaccggagagggtggcggaattccaggtgtaggagtga<br>aatccgtagatatctggaggaacaccggtggcgaaggcggccacctggacggtaactgacgctgaggtgcgaaagc<br>gtgggtagcaaacaggattagataccctggtagtccacgctgtaaacgatgggtgctgggtgctgggatgtatgtctcg |

TABLE 6-continued

Full length 16S rDNA sequences of species (positive correlates)

| Species Name | Sequence Identifier | 16S sequence |
| --- | --- | --- |
| | | gtgccgtagctaacgcgataagcaccccgcctggggagtacggtcgcaaggctgaaactcaaagaaattgacgggg gcccgcacaagcggtggagtatgtggtttaattcgatgcaacgcgaagaaccttacccaggcttgacatctagggaac ccttcggaaatgaaggggtgcccttcggggagccctaagacaggtgctgcatggctgtcgtcagctcgtgccgtgagg tgttgggttaagtcccgcaacgagcgcaacccctatcttcagttgccagcaggtaaggctgggcactctggagagacc gccccggtcaacggggaggaaggtggggacgacgtcaagtcatcatggcccttacgcctggggctacacacgtact acaatggcgcgcacaaagggtagcgagaccgcgaggtggagccaatcccaaaaaacgcgtcccagtccggattgg agtctgcaactcgactccatgaagtcggaatcgctagtaattcgagatcagcatgctcgggtgaatgcgttcccgggcct tgtacacaccgcccgtcacaccacgaaagtcggttttacccgaagccggtgagctaactcgcaagaggagcagccgt ctacggtagggccgatgattggggtgaagtcgtaacaaggtagccgtaggggaacctgcggctggatcacctccttt |
| *Bilophila_ wadsworthia* | SEQ ID NO: 320 | ctggagagtttgattctggctcagattgaacgctggcggcgtgcttaacacatgcaagtcgaacgtgaaagtccttcggg gcgagtaaagtggcgcacgggtgagtaacgcgtggataatctacccttaagatggggataacggctggaaacggtcg ctaataccgaatacgctcccgattttatcattgggggaaagatggcctctgcttgcaagctatcgcttaaggatgagtcc gcgtcccattagctagttggcggggtaacggcccaccaaggcgacgatgggtagccggtctgagaggatgaccggc cacactggaactggaacacggtccagactcctacgggaggcagcagtggggaatattgcgcaatgggcgaaagcct gacgcagcgacgccgcgtgagggatgaaggttctcggatcgtaaacctctgtcagggggaagaaacccccctcgtgt gaataatgcgagggcttgacggtacccccaaaggaagcaccggctaactccgtgccagcagccgcggtaatacgga gggtgcaagcgttaatcggaatcactgggcgtaaagcgcacgtaggcggcaggtaagtcaggggtgaaatcccaca gcccaactgtggaactgcctttgatactgccaggcttgagtaccggagagggtggcggaattccaggtgtaggagtga aatccgtagatatctggaggaacaccggtggcgaaggcggccacctggacggtaactgacgctgaggtgcgaaagc gtgggtagcaaacaggattagataccctggtagtccacgctgtaaacgatgggtgctgggtgctgggatgtatgtctcg gtgccgtagctaacgcgataagcaccccgcctggggagtacggtcgcaaggctgaaactcaaagaaattgacgggg gcccgcacaagcggtggagtatgtgotaattcgatgcaacgcgaagaaccttacccaggcttgacatctagggaac ccttcggaaatgaaggggtgcccttcggggagccctaagacaggtgctgcatggctgtcgtcagctcgtgccgtgagg tgttgggttaagtcccgcaacgagcgcaacccctatcttcagttgccagcaggtaaggctgggcactctggagagacc gccccggtcaacggggaggaaggtggggacgacgtcaagtcatcatggcccttacgcctggggctacacacgtact acaatggcgcgcacaaagggtagcgagaccgcgaggtggagccaatcccaaaaaacgcgtcccagtccggattgg agtctgcaactcgactccatgaagtcggaatcgctagtaattcgagatcagcatgctcgggtgaatgcgttcccgggcct tgtacacaccgcccgtcacaccacgaaagtcggttttacccgaagccggtgagctaactcgcaagaggagcagccgt ctacggtagggccgatgattggggtgaagtcgtaacaaggtagccgtaggggaacctgcggctggatcacctccttt |
| *Bilophila_ wadsworthia* | SEQ ID NO: 321 | ctggagagtttgattctggctcagattgaacgctggcggcgtgcttaacacatgcaagtcgaacgtgaaagtccttcggg gcgagtaaagtggcgcacgggtgagtaacgcgtggataatctacccttaagatggggataacggctggaaacggtcg ctaataccgaatacgctcccgattttatcgttgggggaaagatggcctctgcttgcaagctatcgcttaaggatgagtcc gcgtcccattagctagttggcggggtaacggcccaccaaggcgacgatgggtagccggtctgagaggatgaccggc cacactggaactggaacacggtccagactcctacgggaggcagcagtggggaatattgcgcaatgggcgaaagcct gacgcagcgacgccgcgtgagggatgaaggttctcggatcgtaaacctctgtcagggggaagaaacccccctcgtgt gaataatgcgagggcttgacggtacccccaaaggaagcaccggctaactccgtgccagcagccgcggtaatacgga gggtgcaagcgttaatcggaatcactgggcgtaaagcgcacgtaggcggcttggtaagtcaggggtgaaatcccaca gcccaactgtggaactgcctttgatactgccaggcttgagtaccggagagggtggcggaattccaggtgtaggagtga aatccgtagatatctggaggaacaccggtggcgaaggcggccacctggacggtaactgacgctgaggtgcgaaagc gtgggtagcaaacaggattagataccctggtagtccacgctgtaaacgatgggtgctgggtgctgggatgtatgtctcg gtgccgtagctaacgcgataagcaccccgcctggggagtacggtcgcaaggctgaaactcaaagaaattgacgggg gcccgcacaagcggtggagtatgtggtttaattcgatgcaacgcgaagaaccttacccaggcttgacatctagggaac ccttcggaaatgaaggggtgcccttcggggagccctaagacaggtgctgcatggctgtcgtcagctcgtgccgtgagg tgttgggttaagtcccgcaacgagcgcaacccctatcttcagttgccagcaggtaaggctgggcactctggagagacc gccccggtcaacggggaggaaggtggggacgacgtcaagtcatcatggcccttacgcctggggctacacacgtact acaatggcgcgcacaaagggtagcgagaccgcgaggtggagccaatcccaaaaaacgcgtcccagtccggattgg |

TABLE 6-continued

Full length 16S rDNA sequences of species (positive correlates)

| Species Name | Sequence Identifier | 16S sequence |
|---|---|---|
| | | agtctgcaactcgactccatgaagtcggaatcgctagtaattcgagatcagcatgctcgggtgaatgcgttcccgggcct<br>tgtacacaccgcccgtcacaccacgaaagtcggttttacccgaagccggtgagctaactcgcaagaggagcagccgt<br>ctacggtagggccgatgattggggtgaagtcgtaacaaggtagccgtaggggaacctgcggctggatcacctccttt |
| *Veillonella_parvula* | SEQ ID NO: 322 | ttggagagatgatcctggctcaggacgaacgctggcggcgtgcttaacacatgcaagtcgaacgaagagcgatggaa<br>gcttgcttctatcaatcttagtggcgaacgggtgagtaacgcgtaatcaacctgcccttcagaggggacaacagttgg<br>aaacgactgctaataccgcatacgatctaatctcggcatcgaggatagatgaaaggtggcctctacatgtaagctatcac<br>tgaaggaggggattgcgtctgattagctagttggaggggtaacggcccaccaaggcgatgatcagtagccggtctga<br>gaggatgaacggccacattgggactgagacacggcccagactcctacgggaggcagcagtggggaatcttccgcaa<br>tggacgaaagtctgacggagcaacgccgcgtgagtgatgacggccttcgggttgtaaagctctgttaatcgggacgaa<br>aggccttcttgcgaacagttagaaggattgacggtaccggaatagaaagccacggctaactacgtgccagcagccgc<br>ggtaatacgtaggtggcaagcgctgtccggaattattgggcgtaaagcgcgcgcaggcggatcagtcagtctgtcttaa<br>aagttcggggcttaaccccgtgatgggatggaaactgctgatctagagtatcggagaggaaagtggaattcctagtgta<br>gcggtgaaatgcgtagatattaggaagaacaccagtggcgaaggcgactttctggacgaaaactgacgctgaggcgc<br>gaaagccaggggagcgaacgggattagataccccggtagtcctggccgtaaacgatgggtactaggtgtaggaggt<br>atcgaccccttctgtgccggagttaacgcaataagtaccccgcctggggagtacgaccgcaaggttgaaactcaaagg<br>aattgacgggggcccgcacaagcggtggagtatgtggtttaattcgacgcaacgcgaagaaccttaccaggtcttgac<br>attgatggacagaactagagatagttcctcttcttcggaagccagaaaacaggtggtgcacggttgtcgtcagctcgtgt<br>cgtgagatgttgggttaagtcccgcaacgagcgcaacccctatcttatgttgccagcacgtaatggtgggaactcatga<br>gagactgccgcagacaatgcggaggaaggcggggatgacgtcaaatcatcatgccccttatgacctgggctacacac<br>gtactacaatgggagttaatagacggaagcgagatcgcgagatggagcaaacccgagaaacactctctcagttcggat<br>cgtaggctgcaactcgcctacgtgaagtcggaatcgctagtaatcgcaggtcagcatactgcggtgaatacgttcccgg<br>gccttgtacacaccgcccgtcacaccacgaaagtcggaagtgcccaaagccggtggggtaaccttcgggagccagc<br>cgtctaaggtaaagtcgatgattggggtgaagtcgtaacaaggtagccgtatcggaaggtgcggctggatcacctcctt<br>t |
| *Lachnospiraceae_ bacterium_3_1_57FAA_* CT1 | SEQ ID NO: 323 | agagagatgatcctggctcaggatgaacgctggcggcgtgcctaacacatgcaagtcgaacgaagttacacggagg<br>aagttttcggatggaatcggtataacttagtggcggacgggtgagtaacgcgtgggaaacctgccctgtaccgggga<br>taacacttagaaataggtgctaataccgcataagcgcacggaaccgcatggttccgtgtgaaaaactccggtggtacag<br>gatggtcccgcgtctgattagccagttggcagggtaacggcctaccaaagcgacgatcagtagccggcctgagaggg<br>tgaacggccacattgggactgagacacggcccaaactcctacgggaggcagcagtggggaatattgcacaatgggg<br>gaaaccctgatgcagcgacgccgcgtgagtgaagaagtatttcggtatgtaaagctctatcagcagggaagaaaatga<br>cggtacctgactaagaagccccggctaactacgtgccagcagccgcggtaatacgtagggggcaagcgttatccgga<br>tttactgggtgtaaagggagcgtagacggcatggcaagccagatgtgaaaacccagggctcaaccttgggattgcattt<br>ggaactgccaggctggagtgcaggagaggtaagcggaattcctagtgtagcggtgaaatgcgtagatattaggagga<br>acaccagtggcgaaggcggcttactggactgtaactgacgttgaggctcgaaagcgtggggagcaaacaggattaga<br>taccctggtagtccacgcggtaaacgatgattgctaggtgtaggtgggtatggacccatcggtgccgcagctaacgca<br>ataagcaatccacctggggagtacgttcgcaagaatgaaactcaaaggaattgacggggacccgcacaagcggtgg<br>agcatgtggtttaattcgaagcaacgcgaagaaccttaccaagtcttgacatccccctgaatatcttgtaaaaaagagatg<br>ccttcgggacaggggagacaggtggtgcatggttgtcgtcagctcgtgtcgtgagatgttgggttaagtcccgcaacga<br>gcgcaacccttattcttagtagccagcaggtaaggctgggcactctaaggagactgccggggataacccggaggaag<br>gcggggatgacgtcaaatcatcatgccccttatgatttgggctacacacgtgctacaatggcgtaaacaaagggaagc<br>gagacagtgatgtggagcaaatcccagaaataacgtctcagttcggattgtagtctgcaactcgactacatgaagctgg<br>aatcgctagtaatcgcgaatcagcatgtcgcggtgaatacgttcccgggtcttgtacacaccgcccgtcacaccatggg<br>agttggaaatgcccgaagtctgtgacctaaccgaaagggaggagcagccgaaggcaggtctgataactggggtgaa<br>gtcgtaacaaggtagccgtatcggaaggtgcggctggatcacctccttt |

TABLE 6-continued

| Full length 16S rDNA sequences of species (positive correlates) | | |
|---|---|---|
| Species Name | Sequence Identifier | 16S sequence |
| *Lachnospiraceae_ bacterium_3_1_57FAA_* CT1 | SEQ ID NO: 324 | agagagtttgatcctggctcaggatgaacgctggcggcgtgcctaacacatgcaagtcgaacgaagttatatcgagga agttttcggatggaatcagtataacttagtggcggacgggtgagtaacgcgtgggaaacctgccctgtaccgggggat aacacttagaaataggtgctaataccgcataagcgcacagcttcacatgaagcagtgtgaaaaactccggtggtacag gatggtcccgcgtctgattagccagttggcagggtaacggcctaccaaagcgacgatcagtagccggcctgagaggg tgaacggccacattgggactgagacacggcccaaactcctacgggaggcagcagtggggaatattgcacaatgggg gaaaccctgatgcagcgacgccgcgtgagtgaagaagtatttcggtatgtaaagctctatcagcagggaagaaaatga cggtacctgactaagaagccccggctaactacgtgccagcagccgcggtaatacgtagggggcaagcgttatccgga tttactgggtgtaaagggagcgtagacggcatggcaagccagatgtgaaaacccagggctcaaccttgggattgcattt ggaactgtcaggctggagtgcaggagaggtaagcggaattcctagtgtagcggtgaaatgcgtagatattaggagga acaccagtggcgaaggcggcttactggactgtaactgacgttgaggctcgaaagcgtggggagcaaacaggattaga taccctggtagtccacgcggtaaacgatgattgctaggtgtaggtgggtatggacccatcggtgccgcagctaacgca ataagcaatccacctggggagtacgttcgcaagaatgaaactcaaaggaattgacggggacccgcacaagcggtgg agcatgtggtttaattcgaagcaacgcgaagaaccttaccaagtcttgacatcccccctgactctcctgtaaaagagtgag gccttcgggacattggagacaggtggtgcatggttgtcgtcagctcgtgtcgtgagatgttgggttaagtcccgcaacg agcgcaacccttattcttagtagccagcaggtaaagctgggcactctaaggagactgccggggataacccggaggaa ggcggggatgacgtcaaatcatcatgccccttatgatttgggctacacacgtgctacaatggcgtaaacaaagggaag cgagacagtgatgtggagcaaatcccagaaataacgtctcagttcggattgtagtctgcaactcgactacatgaagctg gaatcgctagtaatcgcgaatcagcatgtcgcggtgaatacgacccgggtatgtacacaccgcccgtcacaccatgg gagttggaaatgcccgaagtctgtgacctaaccgaaagggaggagcagccgaaggcaggtctgataactggggtga agtcgtaacaaggtagccgtatcggaaggtgcggctggatcacctccat |
| Lachnospiraceae_ bacterium_3_1_57FAA_ CT1 | SEQ ID NO: 325 | agagagtttgatcctggctcaggatgaacgctggcggcgtgcctaacacatgcaagtcgaacgaagttacacagagg aagttttcggatggaatcggtataacttagtggcggacgggtgagtaacgcgtgggaaacctgccctgtaccgggga taacacttagaaataggtgctaataccgcataagcgcacggattcacatgaagcagtgtgaaaaactccggtggtacag gatggtcccgcgtctgattagccagaggcagggtaacggcctaccaaagcgacgatcagtagccggcctgagaggg tgaacggccacattgggactgagacacggcccaaactcctacgggaggcagcagtggggaatattgcacaatgggg gaaaccctgatgcagcgacgccgcgtgagtgaagaagtatttcggtatgtaaagctctatcagcagggaagaaaatga cggtacctgactaagaagccccggctaactacgtgccagcagccgcggtaatacgtagggggcaagcgttatccgga tttactgggtgtaaagggagcgtagacggcatggcaagccagatgtgaaaacccagggctcaaccttgggattgcattt ggaactgtcaggctggagtgcaggagaggtaagcggaattcctagtgtagcggtgaaatgcgtagatattaggagga acaccagtggcgaaggcggcttactggactgtaactgacgttgaggctcgaaagcgtggggagcaaacaggattaga taccctggtagtccacgcggtaaacgatgattgctaggtgtaggtgggtatggacccatcggtgccgcagctaacgca ataagcaatccacctggggagtacgttcgcaagaatgaaactcaaaggaattgacggggacccgcacaagcggtgg agcatgtggtttaattcgaagcaacgcgaagaaccttaccaagtcttgacatcccaatgacgcacctgtaaagaggtgtt cccttcggggcattggagacaggtggtgcatggagtcgtcagctcgtgtcgtgagatgagggttaagtcccgcaacg agcgcaacccttattcttagtagccagcaggtaaagctgggcactctaaggagactgccggggataacccggaggaa ggcggggatgacgtcaaatcatcatgccccttatgatttgggctacacacgtgctacaatggcgtaaacaaagggaag cgagacagtgatgtggagcaaatcccagaaataacgtctcagttcggattgtagtctgcaactcgactacatgaagctg gaatcgctagtaatcgcgaatcagcatgtcgcggtgaatacgttcccgggtcttgtacacaccgcccgtcacaccatgg gagttggaaatgcccgaagtctgtgacctaaccgaaagggaggagcagccgaaggcaggtctgataactggggtga agtcgtaacaaggtagccgtatcggaaggtgcggctggatcacctccat |
| *Erysipelotrichaceae_ bacterium_2_2_44A* | SEQ ID NO: 326 | atggagagtttgatcctggctcaggatgaacgctggcggcatgcctaatacatgcaagtcgaacgaagcttcaggaag cagcttccaaagagacttagtggcgaacgggtgagtaacacgtaggtaacctgcccatgtgtccgggataactgctgg aaacggtagctaaaaccggataggtatacagagcgcatgctcagtatattaaagcgcccatcaaggcgtgaacatgga tggacctgcggcgcattagctagttggtgaggtaacggcccaccaaggcgatgatgcgtagccggcctgagagggta aacggccacattgggactgagacacggcccaaactcctacgggaggcagcagtagggaattttcgtcaatgggggaa |

TABLE 6-continued

| Full length 16S rDNA sequences of species (positive correlates) | | |
|---|---|---|
| Species Name | Sequence Identifier | 16S sequence |
| | | accctgaacgagcaatgccgcgtgagtgaagaaggtatcggatcgtaaagctctgttgtaagtgaagaacggctcata gaggaaatgctatgggagtgacggtagcttaccagaaagccacggctaactacgtgccagcagccgcggtaatacgt aggtggcaagcgttatccggaatcattgggcgtaaagggtgcgtaggtggcgtactaagtctgtagtaaaaggcaatg gctcaaccattgtaagctatggaaactggtatgctggagtgcagaagagggcgatggaattccatgtgtagcggtaaaa tgcgtagatatatggaggaacaccagtggcgaaggcggtcgcctggtctgtaactgacactgaggcacgaaagcgtg gggagcaaataggattagataccctagtagtccacgccgtaaacgatgagaactaagtgttggaggaattcagtgctgc agttaacgcaataagttctccgcctggggagtatgcacgcaagtgtgaaactcaaaggaattgacgggggcccgcaca agcggtggagtatgtggtttaattcgaagcaacgcgaagaaccttaccaggccttgacatggaaacaaataccctagag atagggggataattatggatcacacaggtggtgcatggttgtcgtcagctcgtgtcgtgagatgttgggttaagtcccgc aacgagcgcaacccttgtcgcatgttaccagcatcaagttggggactcatgcgagactgccggtgacaaaccggagg aaggtggggatgacgtcaaatcatcatgccccttatggcctgggctacacacgtactacaatggcgaccacaaagagc agcgacttggtgacaagaagcgaatctcataaaggtcgtctcagttcggattgaagtctgcaactcgacttcatgaagtc ggaatcgctagtaatcgcagatcagcatgctgcggtgaatacgttctcgggccttgtacacaccgcccgtcaaaccatg ggagtcagtaatacccgaagccggtggcataaccgtaaggagtgagccgtcgaaggtaggaccgatgactggggtta agtcgtaacaaggtatccctacgggaacgtggggatggatcacctccttt |
| *Rothia_mucilaginosa* | SEQ ID NO: 327 | acggagagtttgattctggctcaggacgaacgctggcggcgtgcttaacacatgcaagtcgaacgatgaagcctagctt gctaggtggattagtggcgaacgggtgagtaatacgtgagtaacctacctttaactctgggataagcctgggaaactgg gtctaataccggatacgaccaatctccgcatggggtgttggtggaaagcgttatgtagtggttatagatgggctcacggc ctatcagcttgttggtgaggtaacggctcaccaaggcgacgacgggtagccggcctgagagggtgaccggccacact gggactgagacacggcccagactcctacgggaggcagcagtggggaatattgcacaatgggcgcaagcctgatgca gcgacgccgcgtgagggatgacggccttcgggttgtaaacctctgttagcagggaagaagagaaattgacggtacct gcagagaaagcgccggctaactacgtgccagcagccgcggtaatacgtagggcgcgagcgttgtccggaattattgg gcgtaaagagcttgtaggcggtttgtcgcgtctgctgtgaaaggccggggcttaactccgtgtattgcagtgggtacgg gcagactagagtgcagtaggggagactggaattcctggtgtagcggtggaatgcgcagatatcaggaggaacaccg atggcgaaggcaggtctctgggctgtaactgacgctgagaagcgaaagcatggggagcgaacaggattagataccct ggtagtccatgccgtaaacgttgggcactaggtgtgggggacattccacgttaccgcgccgtagctaacgcattaagtg ccccgcctggggagtacggccgcaaggctaaaactcaaagaaattgacgggggcccgcacaagcggcggagcatg cggattaattcgatgcaacgcgaagaaccttaccaaggcttgacatatactggaccgcatcagagatggtgtttcccac ggggctggtatacaggtggtgcatggttgtcgtcagctcgtgtcgtgagatgttgggttaagtcccgcaacgagcgcaa ccctcgttctatgttgccagcacgttatggtggggactcataggagactgccggggtcaactcggaggaaggtgggga tgacgtcaaatcatcatgcccatatgtcagggcttcacgcatgctacaatggccggtacagagggagcgatactgtga ggtggagctaatccctaaaagccggtctcagttcggattggggtctgcaactcgaccccatgaagtcggagtcgctagt aatcgcagatcagcaacgctgcggtgaatacgttcccgggccttgtacacaccgcccgtcaagtcacgaaagttggta acacccaaagccggtggcctaaccatcggggagggagccgtctaaggtgggattggcgattgggactaagtcgtaa caaggtagccgtaccggaaggtgcggctggatcacctccttt |
| *Lactobacillus_ rhamnosus* | SEQ ID NO: 328 | tatgagagatgatcaggctcaggatgaacgctggcggcgtgcctaatacatgcaagtcgaacgagttctgattattgaa aggtgcttgcatcttgatttgattttgaacgagtggcggacgggtgagcaacacgtgggtaactgcccttagtgggggat acatttggaaacagatgctaataccgcataaatccaagaaccgcatggttcttggctgaaagatggcgtaagctatcgct tttggatggacccgcggcgtattagctagttggtgaggtaacggctcaccaaggcaatgatacgtagccgaactgaga ggttgatcggccacattgggactgagacacggcccaaactcctacgggaggcagcagtagggaatcttccacaatgg acgcaagtagatggagcaacgccgcgtgagtgaagaaggattcgggtcgtaaaactctgttgttggagaagaatggt cggcagagtaactgttgtcggcgtgacggtatccaaccagaaagccacggctaactacgtgccagcagccgcggtaa tacgtaggtggcaagcgttatccggatttattgggcgtaaagcgagcgcaggcggattttaagtctgatgtgaaagccct cggcttaaccgaggaagtgcatcggaaactgggaaacttgagtgcagaagaggacagtggaactccatgtgtagcgg tgaaatgcgtagatatatggaagaacaccagtggcgaaggcggctgtctggtctgtaactgacgctgaggctcgaaag catgggtagcgaacaggattagataccctggtagtccatgccgtaaacgatgaatgctaggtgttggagggtttccgcc |

TABLE 6-continued

Full length 16S rDNA sequences of species (positive correlates)

| Species Name | Sequence Identifier | 16S sequence |
|---|---|---|
| | | cttcagtgccgcagctaacgcattaagcattccgcctggggagtacgaccgcaaggttgaaactcaaaggaattgacg<br>ggggcccgcacaagcggtggagcatgtggtttaattcgaagcaacgcgaagaaccttaccaggtatgacatcattga<br>tcacctgagagatcaggtttccccttcgggggcaaaatgacaggtggtgtatggttgtcgtcagctcgtgtcgtgagatg<br>agggttaagtcccgcaacgagcgcaaccatatgactagagccagcatttagttgggcactctagtaagactgccggt<br>gacaaaccggaggaaggtggggatgacgtcaaatcatcatgccccttatgacctgggctacacacgtgctacaatgga<br>tggtacaacgagttgcgagaccgcgaggtcaagctaatctcttaaagccattctcagttcggactgtaggctgcaactcg<br>cctacacgaagtcggaatcgctagtaatcgcggatcagcacgccgcggtgaatacgttcccgggccttgtacacaccg<br>cccgtcacaccatgagagtttgtaacacccgaagccggtggcgtaaccatttagggagcgagccgtctaaggtggga<br>caaatgattagggtgaagtcgtaacaaggtagccgtaggagaacctgcggctggatcacctcat |
| *Lactobacillus_ rhamnosus* | SEQ ID NO: 329 | tatgagagatgatcaggctcaggatgaacgctggcggcgtgcctaatacatgcaagtcgaacgagactgattattgaa<br>aggtgchgcatcttgatttaattttgaacgagtggcggacgggtgagtaacacgtgggtaacctgcccttaagtgggg<br>ataacatttggaaacagatgctaataccgcataaatccaagaaccgcatggttcttggctgaaagatggcgtaagctatc<br>gataggatggacccgcggcgtattagctagttggtgaggtaacggctcaccaaggcaatgaatacgtagccgaactg<br>agaggttgatcggccacattgggactgagacacggcccaaactcctacgggaggcagcagtagggaatcttccacaa<br>tggacgcaagtctgatggagcaacgccgcgtgagtgaagaaggctttcgggtcgtaaaactctgttgttggagaagaat<br>ggtcggcagagtaactgttgtcggcgtgacggtatccaaccagaaagccacggctaactacgtgccagcagccgcgg<br>taatacgtaggtggcaagcgttatccggatttattgggcgtaaagcgagcgcaggcggtttttttaagtctgatgtgaaagc<br>cctcggcttaaccgaggaagtgcatcggaaactgggaaacttgagtgcagaagaggacagtggaactccatgtgtag<br>cggtgaaatgcgtagatatatggaagaacaccagtggcgaaggcggctgtctggtctgtaactgacgctgaggctcga<br>aagcatgggtagcgaacaggattagataccctggtagtccatgccgtaaacgatgaatgctaggtgttggagggtttcc<br>gcccttcagtgccgcagctaacgcattaagcattccgcctggggagtacgaccgcaaggttgaaactcaaaggaattg<br>acgggggcccgcacaagcggtggagcatgtggtttaattcgaagcaacgcgaagaaccttaccaggtcttgacatcat<br>tgatcacctgagagatcaggtttccccttcgggggcaaaatgacaggtggtgtatggttgtcgtcagctcgtgtcgtgag<br>atgttgggttaagtcccgcaacgagcgcaacccttatgactagttgccagcatttagttgggcactctagtaagactgcc<br>ggtgacaaaccggaggaaggtggggatgacgtcaaatcatcatgccccttatgacctgggctacacacgtgctacaat<br>ggatggtacaacgagttgcgagaccgcgaggtcaagctaatctcttaaagccattctcagttcggactgtaggctgcaa<br>ctcgcctacacgaagtcggaatcgctagtaatcgcggatcagcacgccgcggtgaatacgacccgggccagtacac<br>accgcccgtcacaccatgagagtttgtaacacccgaagccggtggcgtaacccttttagggagcgagccgtctaaggt<br>gggacaaatgattagggtgaagtcgtaacaaggtagccgtaggagaacctgcggctggatcacctcctt |
| *Klebsiella_oxytoca* | SEQ ID NO: 330 | ttgaagagtttgatcatggctcagattgaacgctggcggcaggcctaacacatgcaagtcgaacggtagcacagagag<br>cttgctctcgggtgacgagtggcggacgggtgagtaatgtctgggaaactgcccgatggagggggataactactgga<br>aacggtagctaataccgcataacgtcgcaagaccaaagagggggaccttagggcctatgccatcggatgtgcccag<br>atgggattagcttgtaggtgaggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggttgtaaagtactttcagcggggaggaagggagtgaggttaataa<br>ccttattcattgacgttacccgcagaagaagcaccggctaactccgtgccagcagccgcggtaatacggagggtgcaa<br>gcgttaatcggaattactgggcgtaaagcgcacgcaggcggtctgtcaagtcggatgtgaaatccccgggctcaacct<br>gggaactgcattcgaaactggcaggctggagtcttgtagaggggggtagaattccaggtgtagcggtgaaatgcgtag<br>agatctggaggaataccggtggcgaaggcggccccctggacaaagactgacgctcaggtgcgaaagcgtggggag<br>caaacaggattagataccctggtagtccacgctgtaaacgatgtcgacttggaggttgttcccttgaggagtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctactcttgacatc |

TABLE 6-continued

Full length 16S rDNA sequences of species (positive correlates)

| Species Name | Sequence Identifier | 16S sequence |
|---|---|---|
| *Clostridium_ perfringens* | SEQ ID NO: 331 | attgagagatgatcctggctcaggatgaacgctggcggcgtgcttaacacatgcaagtcgagcgatgaagtttccttcg ggaaacggattagcggcggacgggtgagtaacacgtgggtaacctgcctcatagagtggaatagccttccgaaagga agattaataccgcataatgttgaaagatggcatcatcattcaaccaaaggagcaatccgctatgagatggacccgcggc gcattagctagttggtggggtaacggcctaccaaggcgacgatgcgtagccgacctgagagggtgatcggccacatt gggactgagacacggcccagactcctacgggaggcagcagtggggaatattgcacaatgggggaaaccctgatgca gcaacgccgcgtgagtgatgaaggttttcggatcgtaaagctctgtcatggggaagataatgacggtacccaaggagg aagccacggctaactacgtgccagcagccgcggtaatacgtaggtggcgagcgttatccggatttactgggcgtaaag ggagcgtaggcggatgattaagtgggatgtgaaatacccgggctcaacttgggtgctgcattccaaactggttatctag agtgcaggagaggagagtggaattcctagtgtagcggtgaaatgcgtagagattaggaagaacaccagtggcgaag gcgactctctggactgtaactgacgctgaggctcgaaagcgtggggagcaaacaggattagataccctggtagtccac gccgtaaacgatgaatactaggtgtgggggtttcaacacctccgtgccgccgctaacgcattaagtattccgcctgggg agtacggtcgcaagattaaaactcaaaggaattgacggggacccgcacaagtagcggagcatgtggtttaattcgaag caacgcgaagaaccttacctacacttgacatcccttgcattactcttaatcgaggaaatcccttcggggacaaggtgaca ggtggtgcatggagtcgtcagctcgtgtcgtgagatgagggttaagtcccgcaacgagcgcaacccttgtcgttagtta ctaccattaagttgaggactctagcgagactgcctgggttaaccaggaggaaggtggggatgacgtcaaatcatcatgc cccttatgtgtagggctacacacgtgctacaatggctggtacagagagatgcaataccgcgaggtggagccaaactta aaaaccagtctcagttcggattgtaggctgaaactcgcctacatgaagctggagttactagtaatcgcgaatcagaatgt cgcggtgaatacgttcccgggtcttgtacacaccgcccgtcacaccatgagagttggcaatacccgaagtccgtgagct aaccgcaaggaggcagcggccgaaggtagggtcagcgattggggtgaagtcgtaacaaggtagccgtaggagaac ctgcggctggatcacctcccttt |
| *Streptococcus_mitis_ oralis*_pneumoniae | SEQ ID NO: 332 | taatgagagtttgatcctggctcaggacgaacgctggcggcgtgcctaatacatgcaagtagaacgctgaaggaggag cttgcttctccggatgagttgcgaacgggtgagtaacgcgtaggtaacctgcctggtagcgggggataactattggaaa cgatagctaataccgcataacagtagatgttgcatgacatttgcttaaaaggtgcaattgcatcactaccagatggacctg cgagtattagctagaggtggggtaacggctcaccaaggcgacgatacatagccgacctgagagggtgatcggccac actgggactgagacacggcccagactcctacgggaggcagcagtagggaatcttcggcaatggacggaagtctgac cgagcaacgccgcgtgagtgaagaaggttttcggatcgtaaagctctgttgtaagagaagaacgagtgtgagagtgga aagttcacactgtgacggtatcttaccagaaagggacggctaactacgtgccagcagccgcggtaatacgtaggtccc gagcgttgtccggatttattgggcgtaaagcgagcgcaggcggttagataagtctgaagttaaaggctgtggcttaacc atagtacgctttggaaactgtttaacttgagtgcaagaggggagagtggaattccatgtgtagcggtgaaatgcgtagat atatggaggaacaccggtggcgaaagcggctctctggcttgtaactgacgctgaggctcgaaagcgtggggagcaaa caggattagataccctggtagtccacgccgtaaacgatgagtgctaggtgttagaccctttccggggtttagtgccgcag ctaacgcattaagcactccgcctggggagtacgaccgcaaggttgaaactcaaaggaattgacgggggcccgcacaa gcggtggagcatgtggtttaattcgaagcaacgcgaagaaccttaccaggtcttgacatccctctgaccgctctagagat agagattccttcgggacagaggtgacaggtggtgcatggttgtcgtcagctcgtgtcgtgagatgttgggttaagtccc gcaacgagcgcaacccctattgttagttgccatcatttagttgggcactctagcgagactgccggtaataaaccggagg aaggtggggatgacgtcaaatcatcatgccccttatgacctgggctacacacgtgctacaatggctggtacaacgagtc gcaagccggtgacggcaagctaatctcttaaagccagtctcagttcggattgtaggctgcaactcgcctacatgaagtc ggaatcgctagtaatcgcggatcagcacgccgcggtgaatacgttcccgggccttgtacacaccgcccgtcacaccac gagagtttgtaacacccgaagtcggtgaggtaaccgtaaggagccagccgcctaaggtgggatagatgattggggtg aagtcgtaacaaggtagccgtatcggaaggtgcggctggatcacctcctt |
| *Bacteroides*_ovatus | SEQ ID NO: 333 | cgatggataggggttctgagaggaaggtcccccacattggaactgagacacggtccaaactcctacgggaggcagca gtgaggaatattggtcaatgggcgagagcctgaaccagccaagtagcgtgaaggatgaaggctctatgggtcgtaaa cttcttttatatgggaataaagttttccacgtgtggaattttgtatgtaccatatgaataaggatcggctaactccgtgccagc agccgcggtaatacggaggatccgagcgttatccggatttattgggtttaaagggagcgtaggtggattgttaagtcagt tgtgaaagtttgcggctcaaccgtaaaattgcagttgaaactggcagtcttgagtacagtagaggtgggcggaattcgtg |

TABLE 6-continued

Full length 16S rDNA sequences of species (positive correlates)

| Species Name | Sequence Identifier | 16S sequence |
| --- | --- | --- |
| | | gtgtagcggtgaaatgcttagatatcacgaagaactccgattgcgaaggcagctcactagactgtcactgacactgatg ctcgaaagtgtgggtatcaaacaggattagataccctggtagtccacacagtaaacgatgaatactcgctgtttgcgatat acagtaagcggccaagcgaaagcattaagtattccacctggggagtacgccggcaacggtgaaactcaaaggaattg acgggggcccgcacaagcggaggaacatgtggtttaattcgatgatacgcgaggaaccttacccgggcttaaattgca acagaatatattggaaacagtatagccgtaaggctgttgtgaaggtgctgcatggttgtcgtcagctcgtgccgtgaggt gtcggcttaagtgccataacgagcgcaacccttatctttagttactaacaggtcatgctgaggactctagagagactgcc gtcgtaagatgtgaggaaggtggggatgacgtcaaatcagcacggccccttacgtccggggctacacacgtgttacaa tgggggtacagaaggcggctacctggtgacaggatgctaatcccaaaaacctctctcagttcggatcgaagtctgca acccgacttcgtgaagctggattcgctagtaatcgcgcatcagccatggcgcggtgaatacgttcccgggccttgtaca caccgcccgtcaagccatgaaagccgggggtacctgaagtacgtaaccgcaaggagcgtcctagggtaaaactggt aattggggctaagtcgtaacaaggtagccgtaccggaaggtgcggctggaacacctcctt |
| *Bacteroides_ovatus* | SEQ ID NO: 334 | atgaagagtttgatcctggctcaggatgaacgctagctacaggcttaacacatgcaagtcgaggggcagcattttagttt gcttgcaaactgaagatggcgaccggcgcacgggtgagtaacacgtatccaacctgccgataactccggaatagcctt tcgaaagaaagattaataccggatagcatacgaatatcgcatgatatttttattaaagaatttcggttatcgatggggatgc gaccattagatgaggcggggtaacggcccaccaagactacgatggataggggttctgagaggaaggtcccccacat tggaactgagacacggtccaaactcctacgggaggcagcagtgaggaatattggtcaatgggcgagagcctgaacca gccaagtagcgtgaaggatgaaggctctatgggtcgtaaacttatttatatgggaataaagtatccacgtgtggaatttt gtatgtaccatatgaataaggatcggctaactccgtgccagcagccgcggtaatacggaggatccgagcgttatccgg atttattgggtttaaagggagcgtaggtggattgttaagtcagttgtgaaagtttgcggctcaaccgtaaaattgcagttga aactggcagtcttgagtacagtagaggtgggcggaattcgtggtgtagcggtgaaatgcttagatatcacgaagaactc cgattgcgaaggcagctcactagactgtcactgacactgatgctcgaaagtgtgggtatcaaacaggattagataccct ggtagtccacacagtaaacgatgaatactcgctgtttgcgatatacagtaagcggccaagcgaaagcattaagtattcca cctggggagtacgccggcaacggtgaaactcaaaggaattgacgggggcccgcacaagcggaggaacatgtggttt aattcgatgatacgcgaggaaccttacccgggcttaaattgcaacagaatatattggaaacagtatagccgtaaggctgt tgtgaaggtgctgcatggagtcgtcagctcgtgccgtgaggtgtcggcttaagtgccataacgagcgcaacccttatctt tagttactaacaggttatgctgaggactctagagagactgccgtcgtaagatgtgaggaaggtggggatgacgtcaaat cagcacggccccttacgtccggggctacacacgtgttacaatgggggtacagaaggcggctacctggtgacaggat gctaatcccaaaaacctctctcagttcggatcgaagtctgcaacccgacttcgtgaagctggattcgctagtaatcgcgc atcagccatggcgcggtgaatacgttcccgggccttgtacacaccgcccgtcaagccatgaaagccgggggtacctg aagtacgtaaccgcaaggagcgtcctagggtaaaactggtaattggggctaagtcgtaacaaggtagccgtaccgga aggtgcggctggaacacctcctt |
| *Bacteroides_ovatus* | SEQ ID NO: 335 | atgaagagtttgatcctggctcaggatgaacgctagctacaggcttaacacatgcaagtcgaggggcagcattttagttt gatgcaaactgaagatggcgaccggcgcacgggtgagtaacacgtatccaacctgccgataactccggaatagcctt tcgaaagaaagattaataccggatagcatacgaatatcgcatgatatttttattaaagaatttcggttatcgatggggatgc gaccattagatgaggcggggtaacggcccaccaagactacgatggataggggttctgagaggaaggtcccccacat tggaactgagacacggtccaaactcctacgggaggcagcagtgaggaatattggtcaatgggcgagagcctgaacca gccaagtagcgtgaaggatgaaggctctatgggtcgtaaacttcattatatgggaataaagtatccacgtgtggaatttt gtatgtaccatatgaataaggatcggctaactccgtgccagcagccgcggtaatacggaggatccgagcgttatccgg atttattgggtttaaagggagcgtaggtggattgttaagtcagttgtgaaagtttgcggctcaaccgtaaaattgcagttga aactggcagtcttgagtacagtagaggtgggcggaattcgtggtgtagcggtgaaatgcttagatatcacgaagaactc cgattgcgaaggcagctcactagactgtcactgacactgatgctcgaaagtgtgggtatcaaacaggattagataccct ggtagtccacacagtaaacgatgaatactcgctgtttgcgatatacagtaagcggccaagcgaaagcattaagtattcca cctggggagtacgccggcaacggtgaaactcaaaggaattgacgggggcccgcacaagcggaggaacatgtggttt aattcgatgatacgcgaggaaccttacccgggcttaaattgcaacagaatatattggaaacagtatagccgtaaggctgt tgtgaaggtgctgcatggttgtcgtcagctcgtgccgtgaggtgtcggcttaagtgccataacgagcgcaacccttatctt tagttactaacaggttatgctgaggactctagagagactgccgtcgtaagatgtgaggaaggtggggatgacgtcaaat |

TABLE 6-continued

Full length 16S rDNA sequences of species (positive correlates)

| Species Name | Sequence Identifier | 16S sequence |
|---|---|---|
| | | cagcacggcccttacgtccggggctacacacgtgttacaatgggggtacagaaggcagctacacggcgacgtgat gctaatcccaaaaacctctctcagttcggatcgaagtctgcaacccgacttcgtgaagctggattcgctagtaatcgcgc atcagccatggcgcggtgaatacgttcccgggccttgtacacaccgcccgtcaagccatgaaagccgggggtacctg aagtacgtaaccgcaaggagcgtcctagggtaaaactggtaattggggctaagtcgtaacaaggtagccgtaccgga aggtgcggctggaacacctcctt |
| *Bacteroides_ovatus* | SEQ ID NO: 336 | atgaagagtttgatcctggctcaggatgaacgctagctacaggcttaacacatgcaagtcgaggggcagcattttagttt gcttgcaaactaaagatggcgaccggcgcacgggtgagtaacacgtatccaacctgccgataactcggggatagcctt tcgaaagaaagattaatatccgatggtatattttctccgcatggtgagaatattaaagaatttcggttatcgatggggatgc gttccattagatgaggcggggtaacggcccaccaagaccacgatggataggggttctgagaggaaggtcccccaca ttggaactgagacacggtccaaactcctacgggaggcagcagtgaggaatattggtcaatggacgagagtctgaacc agccaagtagcgtgaaggatgactgccctatgggttgtaaacttcttttatatgggaataaagtgttccacgtgtgggattt tgtatgtaccatatgaataaggatcggctaactccgtgccagcagccgcggtaatacggaggatccgagcgttatccgg atttattgggtttaaagggagcgtaggtggattgttaagtcagttgtgaaagtttgcggctcaaccgtaaaattgcagttga aactggcagtcttgagtacagtagaggtgggcggaattcgtggtgtagcggtgaaatgcttagatatcacgaagaactc cgattgcgaaggcagctcactagactgttactgacactgatgctcgaaagtgtgggtatcaaacaggattagataccctg gtagtccacacagtaaacgatgaatactcgctgatgcgatatacagtaagcggccaagcgaaagcattaagtattccac ctggggagtacgccggcaacggtgaaactcaaaggaattgacgggggcccgcacaagcggaggaacatgtggttta attcgatgatacgcgaggaaccttacccgggcttaaattgcaacagaatatattggaaacagtatagccgtaaggctgtt gtgaaggtgctgcatggttgtcgtcagctcgtgccgtgaggtgtcggcttaagtgccataacgagcgcaacccttatcttt agttactaacaggtcatgctgaggactctagagagactgccgtcgtaagatgtgaggaaggtggggatgacgtcaaat cagcacggcccttacgtccggggctacacacgtgttacaatgggggtacagaaggcggctacctggtgacaggatg ctaatcccaaaaacctctctcagttcggatcgaagtctgcaacccgacttcgtgaagctggattcgctagtaatcgcgcat cagccatggcgcggtgaatacgttcccgggccttgtacacaccgcccgtcaagccatgaaagccgggggtacctgaa gtacgtaaccgcaaggagcgtcctagggtaaaactggtaattggggctaagtcgtaacaaggtagccgtaccggaag gtgcggctggaacacctcctt |
| *Bacteroides_uniformis* | SEQ ID NO: 337 | actgagacacggtccaaactcctacgggaggcagcagtgaggaatattggtcaatggacgagagtctgaaccagcca agtagcgtgaaggatgactgccctatgggttgtaaacttcttttatacgggaataaagtgaggcacgtgtgcctttttgtat gtaccgtatgaataaggatcggctaactccgtgccagcagccgcggtaatacggaggatccgagcgttatccggattta agggataaagggagcgtaggcggacgcttaagtcagttgtgaaagtagcggctcaaccgtaaaattgcagttgatact gggtgtcttgagtacagtagaggcaggcggaattcgtggtgtagcggtgaaatgcttagatatcacgaagaactccgat tgcgaaggcagcttgctggactgtaactgacgctgatgctcgaaagtgtgggtatcaaacaggattagataccctggta gtccacacagtaaacgatgaatactcgctgtttgcgatatacagtaagcggccaagcgaaagcgttaagtattccacctg gggagtacgccggcaacggtgaaactcaaaggaattgacgggggcccgcacaagcggaggaacatgtggtttaatt cgatgatacgcgaggaaccttacccgggcttgaattgcaactgaatgatgtggagacatgtcagccgcaaggcagttgt gaaggtgctgcatggttgtcgtcagctcgtgccgtgaggtgtcggcttaagtgccataacgagcgcaacccttatcgata gttaccatcaggttatgctggggactctgtcgagactgccgtcgtaagatgtgaggaaggtggggatgacgtcaaatca gcacggcccttacgtccggggctacacacgtgttacaatgggggtacagaaggcagctacacggcgacgtgatgct aatcccgaaagcctctctcagttcggattggagtctgcaacccgactccatgaagctggattcgctagtaatcgcgcatc agccacggcgcggtgaatacgttcccgggccttgtacacaccgcccgtcaagccatgaaagccgggggtacctgaa gtgcgtaaccgcaaggagcgccctagggtaaaactggtgattggggctaagtcgtaacaaggtagccgtaccggaag gtgcggctggaacacctcctt |
| *Bacteroides_uniformis* | SEQ ID NO: 338 | atgaagagtttgatcctggctcaggatgaacgctagctacaggcttaacacatgcaagtcgaggggcagcatgaactta gcttgctaagtttgatggcgaccggcgcacgggtgagtaacacgtatccaacctgccgatgactcggggatagcctttc gaaagaaagattaatacccgatggcatagacttccgcatggtggaactattaaagaatttcggtcatcgatggggatgc gaccattaggttgaggcggggtaacggcccaccaagctttcgatggataggggttctgagaggaaggtcccccacat |

TABLE 6-continued

Full length 16S rDNA sequences of species (positive correlates)

| Species Name | Sequence Identifier | 16S sequence |
|---|---|---|
| | | tggaactgagacacggtccaaactcctacgggaggcagcagtgaggaatattggtcaatggacgagagtctgaacca gccaagtagcgtgaaggatgactgccctatgggttgtaaacttcttttatacgggaataaagtgaggcacgtgtgccttttt gtatgtaccgtatgaataaggatcggctaactccgtgccagcagccgcggtaatacggaggatccgagcgttatccgg atttattgggtttaaagggagcgtaggcggacgcttaagtcagttgtgaaagtttgcggctcaaccgtaaaattgcagttg atactgggtgtcttgagtacagtagaggcaggcggaattcgtggtgtagcggtgaaatgcttagatatcacgaagaact ccgattgcgaaggcagcttgctggactgtaactgacgctgatgctcgaaagtgtgggtatcaaacaggattagataccc tggtagtccacacagtaaacgatgaatactcgctgtttgcgatatacagtaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttgaattgcaactgaatgatgtggagacatgtcagccgcaaggc agttgtgaaggtgctgcatggttgtcgtcagctcgtgccgtgaggtgtcggcttaagtgccataacgagcgcaaccctta tcgatagttaccatcaggttatgctggggactctgtcgagactgccgtcgtaagatgtgaggaaggtggggatgacgtc aaatcagcacggccatacgtccggggctacacacgtgttacaatgggggtacagaaggcagctacacggcgacgt gatgctaatcccgaaagcctctctcagttcggattggagtctgcaacccgactccatgaagctggattcgctagtaatcg cgcatcagccacggcgcggtgaatacgttcccgggccttgtacacaccgcccgtcaagccatgaaagccgggggta cctgaagtgcgtaaccgcaaggagcgccctagggtaaaactggtgattggggctaagtcgtaacaaggtagccgtac cggaaggtgcggctggaacacctcctt |
| *Bacteroides_uniformis* | SEQ ID NO: 339 | actgagacacggtccaaactcctacgggaggcagcagtgaggaatattggtcaatggacgagagtctgaaccagcca agtagcgtgaaggatgactgccctatgggttgtaaacttcttttatacgggaataaagtgaggcacgtgtgcctttttgtat gtaccgtatgaataaggatcggctaactccgtgccagcagccgcggtaatacggaggatccgagcgttatccggattta agggataaagggagcgtaggcggacgcttaagtcagttgtgaaagtagcggctcaaccgtaaaattgcagttgatact gggtgtcttgagtacagtagaggcaggcggaattcgtggtgtagcggtgaaatgcttagatatcacgaagaactccgat tgcgaaggcagcttgctggactgtaactgacgctgatgctcgaaagtgtgggtatcaaacaggattagataccctggta gtccacacagtaaacgatgaatactcgctgtttgcgatatacagtaagcggccaagcgaaagcgttaagtattccacctg gggagtacgccggcaacggtgaaactcaaaggaattgacgggggcccgcacaagcggaggaacatgtggtttaatt cgatgatacgcgaggaaccttacccgggcttgaattgcaactgaatgatgtggagacatgtcagccgcaaggcagttgt gaaggtgctgcatggttgtcgtcagctcgtgccgtgaggtgtcggcttaagtgccataacgagcgcaacccttatcgata gttaccatcaggttatgctggggactctgtcgagactgccgtcgtaagatgtgaggaaggtggggatgacgtcaaatca gcacggcccttacgtccggggctacacacgtgttacaatgggggtacagaaggcagctacacggcgacgtgatgct aatcccgaaagcctctctcagttcggattggagtctgcaacccgactccatgaagctggattcgctagtaatcgcgcatc agccacggcgcggtgaatacgttcccgggccttgtacacaccgcccgtcaagccatgaaagccgggggtacctgaa gtgcgtaaccgcaaggagcgccctagggtaaaactggtgattggggctaagtcgtaacaaggtagccgtaccggaag gtgcggctggaacacctcctt |
| *Bacteroides_uniformis* | SEQ ID NO: 340 | atgaagagtttgatcctggctcaggatgaacgctagctacaggcttaacacatgcaagtcgaggggcagcatgaactta gcttgctaagtagatggcgaccggcgcacgggtgagtaacacgtatccaacctgccgatgactcggggatagcctttc gaaagaaagattaatacccgatggcatagacttccgcatggtagaactattaaagaatttcggtcatcgatggggatgc gttccattaggagttggcggggtaacggcccaccaagccttcgatggataggggttctgagaggaaggtcccccacat tggaactgagacacggtccaaactcctacgggaggcagcagtgaggaatattggtcaatggacgagagtctgaacca gccaagtagcgtgaaggatgactgccctatgggttgtaaacttatttatacgggaataaagtgaggcacgtgtgccattt gtatgtaccgtatgaataaggatcggctaactccgtgccagcagccgcggtaatacggaggatccgagcgttatccgg atttattgggtttaaagggagcgtaggcggacgcttaagtcagttgtgaaagtttgcggctcaaccgtaaaattgcagttg atactgggtgtcttgagtacagtagaggcaggcggaattcgtggtgtagcggtgaaatgcttagatatcacgaagaact ccgattgcgaaggcagcttgctggactgtaactgacgctgatgctcgaaagtgtgggtatcaaacaggattagataccc tggtagtccacacagtaaacgatgaatactcgctgtttgcgatatacagtaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttgaattgcaactgaatgatgtggagacatgtcagccgcaaggc agttgtgaaggtgctgcatggttgtcgtcagctcgtgccgtgaggtgtcggcttaagtgccataacgagcgcaaccctta |

TABLE 6-continued

Full length 16S rDNA sequences of species (positive correlates)

| Species Name | Sequence Identifier | 16S sequence |
| --- | --- | --- |
| | | tcgatagttaccatcaggttatgctggggactctgtcgagactgccgtcgtaagatgtgaggaaggtggggatgacgtc aaatcagcacggcccttacgtccggggctacacacgtgttacaatgggggtacagaaggcagctacacggcgacgt gatgctaatcccgaaagcctctacagttcggattggagtctgcaacccgactccatgaagctggattcgctagtaatcg cgcatcagccacggcgcggtgaatacgacccgggccttgtacacaccgcccgtcaagccatgaaagccgggggta cctgaagtgcgtaaccgcaaggagcgccctagggtaaaactggtgattggggctaagtcgtaacaaggtagccgtac cggaaggtgcggctggaacacctcctt |
| *Bacteroides_uniformis* | SEQ ID NO: 341 | atgaagagtagatcctggctcaggatgaacgctagctacaggcttaacacatgcaagtcgaggggcagcatgaactta gcttgctaagtagatggcgaccggcgcacgggtgagtaacacgtatccaacctgccgatgactcggggatagcctttc gaaagaaagattaatacccgatggcatagacttccgcatggtggaactattaaagaatttcggtcatcgatggggatgc gttccattaggagttggcggggtaacggcccaccaagccttcgatggataggggttctgagaggaaggtcccccacat tggaactgagacacggtccaaactcctacgggaggcagcagtgaggaatattggtcaatggacgagagtctgaacca gccaagtagcgtgaaggatgactgccctatgggagtaaacttctatatacgggaataaagtgaggcacgtgtgccttat gtatgtaccgtatgaataaggatcggctaactccgtgccagcagccgcggtaatacggaggatccgagcgttatccgg atttattgggtttaaagggagcgtaggcggacgcttaagtcagttgtgaaagtttgcggctcaaccgtaaaattgcagttg atactgggtgtcttgagtacagtagaggcaggcggaattcgtggtgtagcggtgaaatgcttagatatcacgaagaact ccgattgcgaaggcagcttgctggactgtaactgacgctgatgctcgaaagtgtgggtatcaaacaggattagataccc tggtagtccacacagtaaacgatgaatactcgctgtttgcgatatacagtaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttgaattgcaactgaatgatgtggagacatgtcagccgcaaggc agagtgaaggtgctgcatggttgtcgtcagctcgtgccgtgaggtgtcggcttaagtgccataacgagcgcaacccttta tcgatagttaccatcaggttatgctggggactctgtcgagactgccgtcgtaagatgtgaggaaggtggggatgacgtc aaatcagcacggcccttacgtccggggctacacacgtgttacaatgggggtacagaaggcagctacacggcgacgt gatgctaatcccgaaagcctctctcagttcggattggagtctgcaacccgactccatgaagctggattcgctagtaatcg cgcatcagccacggcgcggtgaatacgttcccgggccttgtacacaccgcccgtcaagccatgaaagccgggggta cctgaagtgcgtaaccgcaaggagcgccctagggtaaaactggtgattggggctaagtcgtaacaaggtagccgtac cggaaggtgcggctggaacacctcctt |
| *Bacteroides_uniformis* | SEQ ID NO: 342 | atgaagagtagatcctggctcaggatgaacgctagctacaggcttaacacatgcaagtcgaggggcagcatgaactta gcttgctaagtagatggcgaccggcgcacgggtgagtaacacgtatccaacctgccgatgactcggggatagcctttc gaaagaaagattaatacccgatggcatagttcttccgcatggtagaactattaaagaatttcggtcatcgatggggatgc gttccattaggttgttggcggggtaacggcccaccaagccttcgatggataggggttctgagaggaaggtcccccacat tggaactgagacacggtccaaactcctacgggaggcagcagtgaggaatattggtcaatggacgagagtctgaacca gccaagtagcgtgaaggatgactgccctatgggttgtaaacttcttttatacgggaataaagtgaggcacgtgtgcctttttt gtatgtaccgtatgaataaggatcggctaactccgtgccagcagccgcggtaatacggaggatccgagcgttatccgg atttattgggtttaaagggagcgtaggcggacgcttaagtcagttgtgaaagtttgcggctcaaccgtaaaattgcagttg atactgggtgtcttgagtacagtagaggcaggcggaattcgtggtgtagcggtgaaatgcttagatatcacgaagaact ccgattgcgaaggcagcttgctggactgtaactgacgctgatgctcgaaagtgtgggtatcaaacaggattagataccc tggtagtccacacagtaaacgatgaatactcgctgtttgcgatatacagtaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttgaattgcaactgaatgatgtggagacatgtcagccgcaaggc agttgtgaaggtgctgcatggttgtcgtcagctcgtgccgtgaggtgtcggcttaagtgccataacgagcgcaacccttta tcgatagttaccatcaggttatgctggggactctgtcgagactgccgtcgtaagatgtgaggaaggtggggatgacgtc aaaatcagcacggcccttacgtccggggctaccacgtgttacaatgggggtacagaaggcagctacacggcgacgt gatgctaatcccgaaagcctctctcagttcggattggagtctgcaacccgactccatgaagctggattcgctagtaatcg cgcatcagccacggcgcggtgaatacgttcccgggccttgtacacaccgcccgtcaagccatgaaagccgggggta cctgaagtgcgtaaccgcaaggagcgccctagggtaaaactggtgattggggctaagtcgtaacaaggtagccgtac cggaaggtgcggctggaacacctcctt |

TABLE 6-continued

Full length 16S rDNA sequences of species (positive correlates)

| Species Name | Sequence Identifier | 16S sequence |
|---|---|---|
| *Bacteroides_uniformis* | SEQ ID NO: 343 | atgaagagtttgatcctggctcaggatgaacgctagctacaggcttaacacatgcaagtcgaggggcagcatgaactta gcttgctaagtttgatggcgaccggcgcacgggtgagtaacacgtatccaacctgccgatgactcggggatagcctttc gaaagaaagattaatacccgatggcatagttcttccgcatggtagaactattaaagaatttcggtcatcgatggggatgc gttccattaggttgttggcggggtaacggcccaccaagccttcgatggataggggactgagaggaaggtcccccacat tggaactgagacacggtccaaactcctacgggaggcagcagtgaggaatattggtcaatggacgagagtctgaacca gccaagtagcgtgaaggatgactgccctatgggttgtaaacttcttttatacgggaataaagtgaggcacgtgtgccttttt gtatgtaccgtatgaataaggatcggctaactccgtgccagcagccgcggtaatacggaggatccgagcgttatccgg atttattgggtttaaagggagcgtaggcggacgcttaagtcagttgtgaaagtttgcggctcaaccgtaaaattgcagttg atactgggtgtcttgagtacagtagaggcaggcggaattcgtggtgtagcggtgaaatgcttagatatcacgaagaact ccgattgcgaaggcagcttgctggactgtaactgacgctgatgctcgaaagtgtgggtatcaaacaggattagataccc tggtagtccacacagtaaacgatgaatactcgctgtttgcgatatacagtaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttgaattgcaactgaatgatgtggagacatgtcagccgcaaggc agttgtgaaggtgctgcatggttgtcgtcagctcgtgccgtgaggtgtcggcttaagtgccataacgagcgcaacccttta tcgatagttaccatcaggttatgctggggactctgtcgagactgccgtcgtaagatgtgaggaaggtggggatgacgtc aaatcagcacggccatacgtccggggctacacacgtgttacaatgggggtacagaaggcagctacacggcgacgt gatgctaatcccgaaagcctctctcagttcggattggagtctgcaacccgactccatgaagctggattcgctagtaatcg cgcatcagccacggcgcggtgaatacgttcccgggccttgtacacaccgcccgtcaagccatgaaagccgggggta cctgaagtgcgtaaccgcaaggagcgccctagggtaaaactggtgattggggctaagtcgtaacaaggtagccgtac cggaaggtgcggctggaacacctcctt |
| *Bacteroides_vulgatus* | SEQ ID NO: 344 | tttgcatgtactttatgaataaggatcggctaactccgtgccagcagccgcggtaatacggaggatccgagcgttatccg gatttattgggtttaaagggagcgtagatggatgtttaagtcagttgtgaaagtttgcggctcaaccgtaaaattgcagttg atactggatatcttgagtgcagttgaggcaggcggaattcgtggtgtagcggtgaaatgcttagatatcacgaagaactc cgattgcgaaggcagcctgctaagctgcaactgacattgaggctcgaaagtgtgggtatcaaacaggattagataccct ggtagtccacacggtaaacgatgaatactcgctgtttgcgatatacggcaagcggccaagcgaaagcgttaagtattcc acctggggagtacgccggcaacggtgaaactcaaaggaattgacgggggcccgcacaagcggaggaacatgtggt ttaattcgatgatacgcgaggaaccttacccgggcttaaattgcagatgaattacggtgaaagccgtaagccgcaaggc atctgtgaaggtgctgcatggttgtcgtcagctcgtgccgtgaggtgtcggcttaagtgccataacgagcgcaacccttg ttgtcagttactaacaggttctgctgaggactctgacaagactgccatcgtaagatgtgaggaaggtggggatgacgtca aatcagcacggcccttacgtccggggctacacacgtgttacaatgggggtacagagggccgctaccacgcgagtg gatgccaatcccaaaaacctctctcagttcggactggagtctgcaacccgactccacgaagctggattcgctagtaatc gcgcatcagccacggcgcggtgaatacgttcccgggccttgtacacaccgcccgtcaagccatgggagccgggggt acctgaagtgcgtaaccgcgaggagcgccctagggtaaaactggtgactggggctaagtcgtaacaaggtagccgta ccggaaggtgcggctggaacacctccttt |
| *Bacteroides_vulgatus* | SEQ ID NO: 345 | atgaagagtttgatcctggctcaggatgaacgctagctacaggcttaacacatgcaagtcgaggggcagcatggtctta gcttgctaaggccgatggcgaccggcgcacgggtgagtaacacgtatccaacctgccgtctactcttggacagccttct gaaaggaagattaatacaagatggcatcatgagttcacatgttcacatgattaaaggtattccggtagacgatggggatg cgaccattagatagtaggcggggtaacggcccacctagttttcgatggataggggttctgagaggaaggtcccccac attggaactgagacacggtccaaactcctacgggaggcagcagtgaggaatattggtcaatgggcgagagcctgaac cagccaagtagcgtgaaggatgactgccctatgggttgtaaacttcttttataaaggaataaagtcgggtatggataccc gtttgcatgtactttatgaataaggatcggctaactccgtgccagcagccgcggtaatacggaggatccgagcgttatcc ggatttattgggtttaaagggagcgtagatggatgtttaagtcagttgtgaaagtttgcggctcaaccgtaaaattgcagtt gatactggatatcttgagtgcagttgaggcaggcggaattcgtggtgtagcggtgaaatgcttagatatcacgaagaact ccgattgcgaaggcagcctgctaagctgcaactgacattgaggctcgaaagtgtgggtatcaaacaggattagatacc ctggtagtccacacggtaaacgatgaatactcgctgtagcgatatacggcaagcggccaagcgaaagcgttaagtatt |

TABLE 6-continued

Full length 16S rDNA sequences of species (positive correlates)

| Species Name | Sequence Identifier | 16S sequence |
|---|---|---|
| | | ccacctggggagtacgccggcaacggtgaaactcaaaggaattgacgggggcccgcacaagcggaggaacatgtg gataattcgatgatacgcgaggaaccttacccgggcttaaattgcagatgaattacggtgaaagccgtaagccgcaag gcatctgtgaaggtgctgcatggttgtcgtcagctcgtgccgtgaggtgtcggcttaagtgccataacgagcgcaaccc ttgttgtcagttactaacaggttctgctgaggactctgacaagactgccatcgtaagatgtgaggaaggtggggatgacg tcaaatcagcacggcccttacgtccggggctacacacgtgttacaatgggggtacagagggccgctaccacgcgag tggatgccaatcccaaaaacctctctcagttcggactggagtctgcaacccgactccacgaagctggattcgctagtaat cgcgcatcagccacggcgcggtgaatacgttcccgggccttgtacacaccgcccgtcaagccatgggagccggggg tacctgaagtgcgtaaccgcgaggagcgccctagggtaaaactggtgactggggctaagtcgtaacaaggtagccgt accggaaggtgcggctggaacacctcctt |
| *Bacteroides_vulgatus* | SEQ ID NO: 346 | atgaagagtttgatcctggctcaggatgaacgctagctacaggcttaacacatgcaagtcgaggggcagcatggtctta gcttgctaaggccgatggcgaccggcgcacgggtgagtaacacgtatccaacctgccgtctactcttggacagccact gaaaggaagattaatacaagatggcatcatgagtccgcatgttcacatgattaaaggtattccggtaggcgatggggat gcgttccattagatagtaggcggggtaacggcccacctagtcttcgatggataggggttctgagaggaaggtcccccca cattggaactgagacacggtccaaactcctacgggaggcagcagtgaggaatattggtcaatgggcgagagcctgaa ccagccaagtagcgtgaaggatgactgccctatgggttgtaaacttcttttataaaggaataaagtcgggtatgtataccc gtttgcatgtactttatgaataaggatcggctaactccgtgccagcagccgcggtaatacggaggatccgagcgttatcc ggatttattgggtttaaagggagcgtagatggatgtttaagtcagttgtgaaagtttgcggctcaaccgtaaaattgcagtt gatactggatatcttgagtgcagttgaggcaggcggaattcgtggtgtagcggtgaaatgcttagatatcacgaagaact ccgattgcgaaggcagcctgctaagctgcaactgacattgaggctcgaaagtgtgggtatcaaacaggattagatacc ctggtagtccacacggtaaacgatgaatactcgctgtttgcgatatacagcaagcggccaagcgaaagcgttaagtatt ccacctggggagtacgccggcaacggtgaaactcaaaggaattgacgggggcccgcacaagcggaggaacatgtg gataattcgatgatacgcgaggaaccttacccgggcttaaattgcagatgaattacggtgaaagccgtaagccgcaag gcatctgtgaaggtgctgcatggagtcgtcagctcgtgccgtgaggtgtcggcttaagtgccataacgagcgcaaccc ttgttgtcagttactaacaggttctgctgaggactctgacaagactgccatcgtaagatgtgaggaaggtggggatgacg atcaaatcagcacggcccttacgtccggggctacacacgtgttacaatgggggtacagagggccgctaccacgcgg tggatgccaatcccaaaaacctctctcagttcggactggagtctgcaacccgactccacgaagctggattcgctagtaat cgcgcatcagccacggcgcggtgaatacgttcccgggccttgtacacaccgcccgtcaagccatgggagccggggg tacctgaagtgcgtaaccgcgaggagcgccctagggtaaaactggtgactggggctaagtcgtaacaaggtagccgt accggaaggtgcggctggaacacctcctt |
| *Bacteroides_vulgatus* | SEQ ID NO: 347 | atgaagagtttgatcctggctcaggatgaacgctagctacaggcttaacacatgcaagtcgaggggcagcatggtctta gcttgctaaggccgatggcgaccggcgcacgggtgagtaacacgtatccaacctgccgtctactcttggacagccttct gaaaggaagattaatacaagatggcatcatgagtccgcatgttcacatgattaaaggtattccggtagacgatggggat gcgaccattagatagtaggcggggtaacggcccacctagtcttcgatggataggggttctgagaggaaggtcccccca cattggaactgagacacggtccaaactcctacgggaggcagcagtgaggaatattggtcaatgggcgcaggcctgaa ccagccaagtagcgtgaaggatgactgccctatgggttgtaaacttcttttataaaggaataaagtcgggtatgcataccc gtttgcatgtactttatgaataaggatcggctaactccgtgccagcagccgcggtaatacggaggatccgagcgttatcc ggatttattgggtttaaagggagcgtagatggatgtttaagtcagttgtgaaagtttgcggctcaaccgtaaaattgcagtt gatactggatatcttgagtgcagttgaggcaggcggaattcgtggtgtagcggtgaaatgcttagatatcacgaagaact ccgattgcgaaggcagcctgctaagctgcaactgacattgaggctcgaaagtgtgggtatcaaacaggattagatacc ctggtagtccacacggtaaacgatgaatactcgctgtttgcgatatacagcaagcggccaagcgaaagcgttaagtatt ccacctggggagtacgccggcaacggtgaaactcaaaggaattgacgggggcccgcacaagcggaggaacatgtg gataattcgatgatacgcgaggaaccttacccgggcttaaattgcagatgaattttcggtgaaagccgtaagccgcaag gcatctgtgaaggtgctgcatggttgtcgtcagctcgtgccgtgaggtgtcggcttaagtgccataacgagcgcaaccc ttgttgtcagttactaacaggttccgctgaggactctgacaagactgccatcgtaagatgtgaggaaggtggggatgac gtcaaatcagcacggcccttacgtccggggctacacacgtgttacaatgggggtacagagggtcgctaccacgcga gtggatgccaatccccaaaacctctctcagttcggactggagtctgcaacccgactccacgaagctggattcgctagta |

TABLE 6-continued

Full length 16S rDNA sequences of species (positive correlates)

| Species Name | Sequence Identifier | 16S sequence |
| --- | --- | --- |
| | | atcgcgcatcagccacggcgcggtgaatacgttcccgggccttgtacacaccgcccgtcaagccatgggagccggg ggtacctgaagtgcgtaaccgcgaggagcgccctagggtaaaactggtgactggggctaagtcgtaacaaggtagcc gtaccggaaggtgcggctggaacacctcctt |
| *Bacteroides_vulgatus* | SEQ ID NO: 348 | atgaagagtttgatcctggctcaggatgaacgctagctacaggcttaacacatgcaagtcgaggggcagcatggtctta gcttgctaaggccgatggcgaccggcgcacgggtgagtaacacgtatccaacctgccgtctactcdggacagccact gaaaggaagattaatacaagatggcatcatgagtccgcatgttcacatgattaaaggtattccggtagacgatggggat gcgttccattagatagtaggcggggtaacggcccacctagtcttcgatggatagggggttctgagaggaaggtcccccca cattggaactgagacacggtccaaactcctacgggaggcagcagtgaggaatattggtcaatgggcgagagcctgaa ccagccaagtagcgtgaaggatgactgccctatgggttgtaaacttcttttataaaggaataaagtcgggtatggatacc cgtttgcatgtactttatgaataaggatcggctaactccgtgccagcagccgcggtaatacggaggatccgagcgttatc cggatttattgggtttaaagggagcgtagatggatgtttaagtcagttgtgaaagtttgcggctcaaccgtaaaattgcagt tgatactggatatcttgagtgcagttgaggcaggcggaattcgtggtgtagcggtgaaatgatagatatcacgaagaac tccgattgcgaaggcagcctgctaagctgcaactgacattgaggctcgaaagtgtgggtatcaaacaggattagatacc ctggtagtccacacggtaaacgatgaatactcgctgtttgcgatatacagcaagcggccaagcgaaagcgttaagtatt ccacctggggagtacgccggcaacggtgaaactcaaaggaattgacgggggcccgcacaagcggaggaacatgtg gataattcgatgatacgcgaggaaccttacccgggcttaaattgcagatgaattttcggtgaaagccgtaagccgcaag gcatctgtgaaggtgctgcatggttgtcgtcagctcgtgccgtgaggtgtcggcttaagtgccataacgagcgcaaccc ttgttgtcagttactaacaggttctgctgaggactctgacaagactgccatcgtaagatgtgaggaaggtggggatgacg tcaaatcagcacggcccttacgtccggggctacacacgtgttacaatggggggtacagagggccgctaccacgcgag tggatgccaatcccaaaaacctctctcagttcggactggagtctgcaacccgactccacgaagctggattcgctagtaat cgcgcatcagccacggcgcggtgaatacgttcccgggccttgtacacaccgcccgtcaagccatgggagccggggg tacctgaagtgcgtaaccgcgaggagcgccctagggtaaaactggtgactggggctaagtcgtaacaaggtagccgt accggaaggtgcggctggaacacctcctt |
| *Bacteroides_vulgatus* | SEQ ID NO: 349 | ccgtttgcatgtactttatgaataaggatcggctaactccgtgccagcagccgcggtaatacggaggatccgagcgttat ccggatttattgggtttaaagggagcgtagatggatgtttaagtcagttgtgaaagtttgcggctcaaccgtaaaattgca gagatactggatatatgagtgcagttgaggcaggcggaattcgtggtgtagcggtgaaatgcttagatatcacgaaga actccgattgcgaaggcagcctgctaagctgcaactgacattgaggctcgaaagtgtgggtatcaaacaggattagata ccctggtagtccacacggtaaacgatgaatactcgctgtttgcgatatacagcaagcggccaagcgaaagcgttaagta ttccacctggggagtacgccggcaacggtgaaactcaaaggaattgacgggggcccgcacaagcggaggaacatgt ggtttaattcgatgatacgcgaggaaccttacccgggcttaaattgcagatgaattacggtgaaagccgtaagccgcaa ggcatctgtgaaggtgctgcatggttgtcgtcagctcgtgccgtgaggtgtcggcttaagtgccataacgagcgcaacc cttgttgtcagttactaacaggttctgctgaggactctgacaagactgccatcgtaagatgtgaggaaggtggggatgac gtcaaatcagcacggcccttacgtccggggctacacacgtgttacaatggggggtacagagggccgctaccacgcga gtggatgccaatccccaaaacctctctcagttcggactggagtctgcaacccgactccacgaagctggattcgctagta atcgcgcatcagccacggcgcggtgaatacgttcccgggccttgtacacaccgcccgtcaagccatgggagccggg ggtacctgaagtgcgtaaccgcgaggagcgccctagggtaaaactggtgactggggctaagtcgtaacaaggtagcc gtaccggaaggtgcggctggaacacctccttt |
| *Eubacterium*_sp_3_1_ 31 | SEQ ID NO: 350 | atggagagtagatcctggctcaggatgaacgctggcggcatgcctaatacatgcaagtcgaacgaagtcataggaag cttgcttccaaagagacttagtggcgaacgggtgagtaacacgtaggtaacctgcccatgtgcccgggataactgctgg aaacggtagctaaaaccggataggtatgagggaggcatcttcctcatattaaagcaccttcgggtgtgaacatggatgg acctgcggcgcattagctggttggtgaggtaacggcccaccaaggcgatgatgcgtagccgacctgagagggtgaac ggccacattgggactgagacacggcccaaactcctacgggaggcagcagtagggaattttcgtcaatgggggaac cctgaacgagcaatgccgcgtgtgtgaagaaggtcttcggatcgtaaagcactgagtaagtgaagaatgccacataga ggaaatgctatgtgggtgacggtagcttaccagaaagccacggctaactacgtgccagcagccgcggtaatacgtag gtggcaagcgttatccggaatcattgggcgtaaagggtgcgtaggtggcacgataagtctgaagtaaaaggcaacag |

TABLE 6-continued

Full length 16S rDNA sequences of species (positive correlates)

| Species Name | Sequence Identifier | 16S sequence |
|---|---|---|
| | | ctcaactgagtatgctttggaaactgtcgagctagagtgcagaagagggcgatggaattccatgtgtagcggtaaaatg cgtagatatatggaggaacaccagtggcgaaggcggtcgcctggtctgtaactgacactgatgcacgaaagcgtggg gagcaaataggattagataccctagtagtccacgccgtaaacgatgagaactaagtgttggagagattcagtgctgcag ttaacgcaataagttctccgcctggggagtatgcacgcaagtgtgaaactcaaaggaattgacgggggcccgcacaag cggtggagtatgtggtttaattcgaagcaacgcgaagaaccttaccaggccttgacatggatataaatgttctagagata gaaagatagctatatatcacacaggtggtgcatggttgtcgtcagctcgtgtcgtgagatgttgggttaagtcccgcaac gagcgcaacccagtcttctgttaccagcattaggttggggactcaggagagactgccggtgacaaaccggaggaagg tggggatgacgtcaaatcatcatgccccttatggcctgggctacacacgtactacaatggcgcctacaaagagcagcg acaccgcgaggtggagcgaatctcataaagggcgtctcagttcggattgaagtctgcaactcgacttcatgaagtcgga atcgctagtaatcgcagatcagcatgctgcggtgaatacgttctcgggccttgtacacaccgcccgtcaaaccatggga gttggtaatacccgaagccggtggcataaccgcaaggagtgagccgtcgaaggtaggaccgatgactggggttaagt cgtaacaaggtatccctacgggaacgtggggatggatcacctccttt |
| *Eubacterium*_sp_3_1_ 31 | SEQ ID NO: 351 | atggagagtttgatcctggctcaggatgaacgctggcggcatgcctaatacatgcaagtcgaacgaagtctttaggaag cttgcttccaaagagacttagtggcgaacgggtgagtaacacgtaggtaacctgcccatgtgcccgggataactgctgg aaacggtagctaaaaccggataggtatgagggaggcatcttcctcatattaaagcaccttcgggtgtgaacatggatgg acctgcggcgcattagctggttggtgaggtaacggcccaccaaggcgatgatgcgtagccgacctgagagggtgaac ggccacattgggactgagacacggcccaaactcctacgggaggcagcagtagggaattttcgtcaatgggggaac cctgaacgagcaatgccgcgtgtgtgaagaaggtcttcggatcgtaaagcactgagtaagtgaagaatgccacataga ggaaatgctatgtgggtgacggtagcttaccagaaagccacggctaactacgtgccagcagccgcggtaatacgtag gtggcaagcgttatccggaatcattgggcgtaaagggtgcgtaggtggcacgataagtctgaagtaaaaggcaacag ctcaactgagtatgctttggaaactgtcgagctagagtgcagaagagggcgatggaattccatgtgtagcggtaaaatg cgtagatatatggaggaacaccagtggcgaaggcggtcgcctggtctgtaactgacactgatgcacgaaagcgtggg gagcaaataggattagataccctagtagtccacgccgtaaacgatgagaactaagtgttggagagattcagtgctgcag ttaacgcaataagttctccgcctggggagtatgcacgcaagtgtgaaactcaaaggaattgacgggggcccgcacaag cggtggagtatgtggtttaattcgaagcaacgcgaagaaccttaccaggccttgacatggatataaatgttctagagata gaaagatagctatatatcacacaggtggtgcatggttgtcgtcagctcgtgtcgtgagatgttgggttaagtcccgcaac gagcgcaacccttgtcttctgttaccagcattaggttggggactcaggagagactgccggtgacaaaccggaggaagg tggggatgacgtcaaatcatcatgccccttatggcctgggctacacacgtactacaatggcgcctacaaagagcagcg acaccgcgaggtggagcgaatctcataaagggcgtctcagttcggattgaagtctgcaactcgacttcatgaagtcgga atcgctagtaatcgcagatcagcatgctgcggtgaatacgttctcgggccttgtacacaccgcccgtcaaaccatggga gttggtaatacccgaagccggtggcataaccgcaaggagtgagccgtcgaaggtaggaccgatgactggggttaagt cgtaacaaggtatccctacgggaacgtggggatggatcacctccttt |
| *Eubacterium*_sp_3_1_ 31 | SEQ ID NO: 352 | atggagagatgatcctggctcaggatgaacgctggcggcatgcctaatacatgcaagtcgaacgaagtcataggaag cttgcttccaaagagacttagtggcgaacgggtgagtaacacgtaggtaacctgcccatgtgcccgggataactgctgg aaacggtagctaaaaccggataggtatgagggaggcatcttcctcatattaaagcaccttcgggtgtgaacatggatgg acctgcggcgcattagctggttggtgaggtaacggcccaccaaggcgatgatgcgtagccgacctgagagggtgaac ggccacattgggactgagacacggcccaaactcctacgggaggcagcagtagggaattttcgtcaatgggggaac cctgaacgagcaatgccgcgtgtgtgaagaaggtcttcggatcgtaaagcactgagtaagtgaagaatgccatataga ggaaatgctatgtgggtgacggtagcttaccagaaagccacggctaactacgtgccagcagccgcggtaatacgtag gtggcaagcgttatccggaatcattgggcgtaaagggtgcgtaggtggcacgataagtctgaagtaaaaggcaacag ctcaactgagtatgctttggaaactgtcgagctagagtgcagaagagggcgatggaattccatgtgtagcggtaaaatg cgtagatatatggaggaacaccagtggcgaaggcggtcgcctggtctgtaactgacactgatgcacgaaagcgtggg gagcaaataggattagataccctagtagtccacgccgtaaacgatgagaactaagtgttggagagattcagtgctgcag ttaacgcaataagttctccgcctggggagtatgcacgcaagtgtgaaactcaaaggaattgacgggggcccgcacaag cggtggagtatgtggtttaattcgaagcaacgcgaagaaccttaccaggccttgacatggatataaatgttctagagata gaaagatagctatatatcacacaggtggtgcatggagtcgtcagctcgtgtcgtgagatgagggttaagtcccgcaac |

TABLE 6-continued

Full length 16S rDNA sequences of species (positive correlates)

| Species Name | Sequence Identifier | 16S sequence |
|---|---|---|
| | | gagcgcaacccttgtcttctgttaccagcattaggttggggactcaggagagactgccggtgacaaaccggaggaagg tggggatgacgtcaaatcatcatgccccttatggcctgggctacacacgtactacaatggcgcctacaaagagcagcg acaccgcgaggtgaagcgaatctcataaagggcgtctcagttcggattgaagtctgcaactcgacttcatgaagtcgga atcgctagtaatcgcagatcagcatgctgcggtgaatacgttctcgggccttgtacacaccgcccgtcaaaccatggga gttggtaatacccgaagccggtggcataaccgcaaggagtgagccgtcgaaggtaggaccgatgactggggttaagt cgtaacaaggtatccctacgggaacgtggggatggatcacctccttt |
| *Eubacterium*_sp_3_1_ 31 | SEQ ID NO: 353 | atggagagtagatcctggctcaggatgaacgctggcggcatgcctaatacatgcaagtcgaacgaagtcataggaag cagcaccaaagagacttagtggcgaacgggtgagtaacacgtaggtaacctgcccatgtgcccgggataactgctgg aaacggtagctaaaaccggataggtatgagggaggcatcttcctcatattaaagcaccacgggtgtgaacatggatgg acctgcggcgcattagctggttggtgaggtaacggcccaccaaggcgatgatgcgtagccgacctgagagggtgaac ggccacattgggactgagacacggcccaaactcctacgggaggcagcagtagggaattacgtcaatgggggaac cctgaacgagcaatgccgcgtgtgtgaagaaggtcttcggatcgtaaagcactgttgtaagtgaagaatgccacataga ggaaatgctatgtgggtgacggtagcttaccagaaagccacggctaactacgtgccagcagccgcggtaatacgtag gtggcaagcgttatccggaatcattgggcgtaaagggtgcgtaggtggcacgataagtctgaagtaaaaggcaacag ctcaactgagtatgctttggaaactgtcgagctagagtgcagaagagggcgatggaattccatgtgtagcggtaaaatg cgtagatatatggaggaacaccagtggcgaaggcggtcgcctggtctgtaactgacactgatgcacgaaagcgtggg gagcaaataggattagataccctagtagtccacgccgtaaacgatgagaactaagtgttggagagattcagtgctgcag ttaacgcaataagttctccgcctggggagtatgcacgcaagtgtgaaactcaaaggaattgacgggggcccgcacaag cggtggagtatgtggtttaattcgaagcaacgcgaagaaccttaccaggccttgacatggatataaatgttctagagata gaaagatagctatatatcacacaggtggtgcatggttgtcgtcagctcgtgtcgtgagatgttgggttaagtcccgcaac gagcgcaacccttgtcttctgttaccagcattaagttggggactcaggagagactgccggtgacaaaccggaggaagg tggggatgacgtcaaatcatcatgccccttatggcctgggctacacacgtactacaatggcgcctacaaagagcagcg acaccgcgaggtggagcgaatctcataaagggcgtctcagttcggattgaagtctgcaactcgacttcatgaagtcgga atcgctagtaatcgcagatcagcatgctgcggtgaatacgttctcgggccttgtacacaccgcccgtcaaaccatggga gttggtaatacccgaagccggtggcataaccgcaaggagtgagccgtcgaaggtaggaccgatgactggggttaagt cgtaacaaggtatccctacgggaacgtggggatggatcacctccttt |
| *Eubacterium*_sp_3_1_ 31 | SEQ ID NO: 354 | atggagagtttgatcctggctcaggatgaacgctggcggcatgcctaatacatgcaagtcgaacgaagtctttaggaag cttgcaccaaagagacttagtggcgaacgggtgagtaacacgtaggtaacctgcccatgtgcccgggataactgctgg aaacggtagctaaaaccggataggtatgagggaggcatcttcctcatattaaagcaccttcgggtgtgaacatggatgg acctgcggcgcattagctggttggtgaggtaacggcccaccaaggcgatgatgcgtagccgacctgagagggtgaac ggccacattgggactgagacacggcccaaactcctacgggaggcagcagtagggaattttcgtcaatgggggaac cctgaacgagcaatgccgcgtgtgtgaagaaggtatcggatcgtaaagcactgagtaagtgaagaatgccatataga ggaaatgctatgtgggtgacggtagcttaccagaaagccacggctaactacgtgccagcagccgcggtaatacgtag gtggcaagcgttatccggaatcattgggcgtaaagggtgcgtaggtggcacgataagtctgaagtaaaaggcaacag ctcaactgagtatgctttggaaactgtcgagctagagtgcagaagagggcgatggaattccatgtgtagcggtaaaatg cgtagatatatggaggaacaccagtggcgaaggcggtcgcctggtctgtaactgacactgatgcacgaaagcgtggg gagcaaataggattagataccctagtagtccacgccgtaaacgatgagaactaagtgttggagagattcagtgctgcag ttaacgcaataagttctccgcctggggagtatgcacgcaagtgtgaaactcaaaggaattgacgggggcccgcacaag cggtggagtatgtggtttaattcgaagcaacgcgaagaaccttaccaggccttgacatggatataaatgttctagagata gaaagatagctatatatcacacaggtggtgcatggttgtcgtcagctcgtgtcgtgagatgttgggttaagtcccgcaac gagcgcaacccttgtcttctgttaccagcattaggttggggactcaggagagactgccggtgacaaaccggaggaagg tggggatgacgtcaaatcatcatgccccttatggcctgggctacacacgtactacaatggcgcctacaaagagcagcg acaccgcgaggtggagcgaatctcataaagggcgtctcagttcggattgaagtctgcaactcgacttcatgaagtcgga atcgctagtaatcgcagatcagcatgctgcggtgaatacgttctcgggccttgtacacaccgcccgtcaaaccatggga gttggtaatacccgaagccggtggcataaccgcaaggagtgagccgtcgaaggtaggaccgatgactggggttaagt cgtaacaaggtatccctacgggaacgtggggatggatcacctccttt |

TABLE 6-continued

Full length 16S rDNA sequences of species (positive correlates)

| Species Name | Sequence Identifier | 16S sequence |
|---|---|---|
| *Morganella_morganii* | SEQ ID NO: 355 | ggggataactactggaaacggtagctaataccgcataatgtcttcggaccaaagcgggggacctccgggcctcgcgc<br>catcagatgaacccatatgggattagctagtaggtgaggtaacggcttacctaggcgacgatccctagctggtctgaga<br>ggatgatcagccacactgggactgagacacggcccagactcctacgggaggcagcagtggggaatattgcacaatg<br>ggcgcaagcctgatgcagccatgccgcgtgtatgaagaaggccttcgggttgtaaagtactttcagtcgggaggaagg<br>tgtcaaggttaataaccttggcaattgacgttaccgacagaagaagcaccggctaactccgtgccagcagccgcggta<br>atacggagggtgcaagcgttaatcggaattactgggcgtaaagcgcacgcaggcggagattgagtcagatgtgaaat<br>ccccgggataacccgggaattgcatctgatactggtcagctagagtcttgtagagggggggtagaattccatgtgtagc<br>ggtgaaatgcgtagagatgtggaggaataccggtggcgaaggcggcccccctggacaaagactgacgctcaggtgcg<br>aaagcgtggggagcaaacaggattagataccctggtagtccacgctgtaaacgatgtcgacttggaggttgtgcccttg<br>aggcgtggcttccggagctaacgcgttaagtcgaccgcctggggagtacggccgcaaggttaaaactcaaatgaattg<br>acgggggcccgcacaagcggtggagcatgtggtttaattcgatgcaacgcgaagaaccttacctactcttgacatcca<br>gagaacttagcagagatgctttggtgccttcgggaactctgagacaggtgctgcatggctgtcgtcagctcgtgttgtga<br>aatgttgggttaagtcccgcaacgagcgcaacccttatcctttgttgccagcgcgtgatggcgggaactcaaaggagac<br>tgccggtgataaaccggaggaaggtggggatgacgtcaagtcatcatggcccttacgagtagggctacacacgtgcta<br>caatggcgtatacaaagggaagcgaccccgcgagggcaagcggaactcataaagtacgtcgtagtccggattggagt<br>ctgcaactcgactccatgaagtcggaatcgctagtaatcgtagatcagaatgctacggtgaatacgttcccgggccttgt<br>acacaccgcccgtcacaccatgggagtgggttgcaaaagaagtaggtagcttaacctccgggagggcgcttaccactt<br>tgtgattcatgactggggtgaagtcgtaacaaggtaaccgtaggggaacctgcggaggatcacctcctt |
| *Parabacteroides_ distasanis* | SEQ ID NO: 356 | cgaagagtttgatcctggctcaggatgaacgctagcgacaggcttaacacatgcaagtcgaggggcagcacaggtag<br>caataccgggtggcgaccggcgcacgggtgagtaacgcgtatgcaacttacctatcagaggggggataacccggcga<br>aagtcggactaataccgcatgaagcaggggtcccgcatggggatatttgctaaagattcatcgctgatagataggcatg<br>cgaccattaggcagaggcggggtaacggcccaccaaaccgacgatggatagggactgagaggaaggtccccca<br>cattggtactgagacacggaccaaactcctacgggaggcagcagtgaggaatattggtcaatgggcgtaagcctgaa<br>ccagccaagtcgcgtgagggatgaaggttctatggatcgtaaacctcttttataagggaataaagtgcgggacgtgtcct<br>gattgtatgtaccttatgaataaggatcggctaactccgtgccagcagccgcggtaatacggaggatccgagcgttatc<br>cggatttattgggataaagggtgcgtaggcggcctataagtcagcggtgaaagtctgtggctcaaccatagaattgccg<br>ttgaaactgggggcttgagtatgatgaggcaggcggaatgcgtggtgtagcggtgaaatgatagatatcacgcaga<br>accccgattgcgaaggcagcctgccaagccatgactgacgctgatgcacgaaagcgtggggatcaaacaggattag<br>ataccctggtagtccacgcagtaaacgatgatcactagctgatgcgatacagtgtaagcggcacagcgaaagcgttaa<br>gtgatccacctggggagtacgccggcaacggtgaaactcaaaggaattgacgggggcccgcacaagcggaggaac<br>atgtggataattcgatgatacgcgaggaaccttacccgggtagaacgcattcggaccgaggtggaaacaccattctag<br>caatagccgtttgcgaggtgctgcatggttgtcgtcagctcgtgccgtgaggtgtcggcttaagtgccataacgagcgc<br>aacccttgccactagttactaacaggtaaagctgaggactctggtgggactgccagcgtaagctgcgaggaaggcgg<br>ggatgacgtcaaatcagcacggccatacatccggggcgacacacgtgttacaatggcgtggacaaagggaggcca<br>cctggcgacagggagcgaatccccaaaccacgtctcagttcggatcggagtctgcaacccgactccgtgaagctgga<br>ttcgctagtaatcgcgcatcagccatggcgcggtgaatacgttcccgggccttgtacacaccgcccgtcaagccatgg<br>gagccgggggtacctgaagtccgtaaccgcgaggatcggcctagggtaaaactggtgactggggctaagtcgtaaca<br>aggtagccgtaccggaaggtgcggctggaacacctccat |
| *Parabacteroides_ distasanis* | SEQ ID NO: 357 | cgaagagtttgatcctggctcaggatgaacgctagcgacaggcttaacacatgcaagtcgaggggcagcacaggtag<br>caataccgggtggcgaccggcgcacgggtgagtaacgcgtatgcaacttgcctatcagaggggggataacccggcga<br>aagtcggactaataccgcatgaagcaggggccccgcatggggatatttgctaaagattcatcgctgatagataggcatg<br>cgaccattaggcagaggcggggtaacggcccaccaaaccgacgatggatagggactgagaggaaggtccccca<br>cattggtactgagacacggaccaaactcctacgggaggcagcagtgaggaatattggtcaatgggcgcgagcctgaa<br>ccagccaagtcgcgtgagggatgaaggttctatggatcgtaaacctcttttataagggaataaagtgcgggacgtgtcct<br>gattgtatgtaccttatgaataaggatcggctaactccgtgccagcagccgcggtaatacggaggatccgagcgttatc |

TABLE 6-continued

Full length 16S rDNA sequences of species (positive correlates)

| Species Name | Sequence Identifier | 16S sequence |
| --- | --- | --- |
| | | cggatttattgggtttaaagggtgcgtaggcggccttttaagtcagcggtgaaagtctgtggctcaaccatagaattgccg ttgaaactgggggggcttgagtatgatgaggcaggcggaatgcgtggtgtagcggtgaaatgatagatatcacgcaga accccgattgcgaaggcagcctgccaagccatgactgacgctgatgcacgaaagcgtggggatcaaacaggattag ataccctggtagtccacgcagtaaacgatgatcactagctgatgcgatacagtgtaagcggcacagcgaaagcgttaa gtgatccacctggggagtacgccggcaacggtgaaactcaaaggaattgacgggggcccgcacaagcggaggaac atgtggataattcgatgatacgcgaggaaccttacccgggtagaacgcattcggaccgaggtggaaacaccattctag caatagccgtttgcgaggtgctgcatggttgtcgtcagctcgtgccgtgaggtgtcggcttaagtgccataacgagcgc aacccttgccactagttactaacaggtaaagctgaggactctggtgggactgccagcgtaagctgcgaggaaggcgg ggatgacgtcaaatcagcacggccatacatccggggcgacacacgtgttacaatggcgtggacaaagggatgccac ctggcgacagggagcgaatccccaaaccacgtctcagttcggatcggagtctgcaacccgactccgtgaagctggatt cgctagtaatcgcgcatcagccatggcgcggtgaatacgttcccgggccttgtacacaccgcccgtcaagccatggga gccgggggtacctgaagtccgtaaccgaaaggatcggcctagggtaaaactggtgactggggctaagtcgtaacaag gtagccgtaccggaaggtgcggctggaacacctccat |
| *Parabacteroides_ distasanis* | SEQ ID NO: 358 | cgaagagtttgatcctggctcaggatgaacgctagcgacaggcttaacacatgcaagtcgaggggcagcacaggtag caataccgggtggcgaccggcgcacgggtgagtaacgcgtatgcaacttacctatcagaggggggataacccggcga aagtcggactaataccgcatgaagcaggggtcccgcatggggatatttgctaaagattcatcgctgatagataggcatg cgttccattaggcagttggcggggtaacggcccaccaaaccgacgatggataggggttctgagaggaaggtcccccca cattggtactgagacacggaccaaactcctacgggaggcagcagtgaggaatattggtcaatgggcgcgagcctgaa ccagccaagtcgcgtgagggatgaaggttctatggatcgtaaacctcttttataagggaataaagtgcgggacgtgtcct gttttgtatgtaccttatgaataaggatcggctaactccgtgccagcagccgcggtaatacggaggatccgagcgttatc cggatttattgggtttaaagggtgcgtaggcggccttttaagtcagcggtgaaagtctgtggctcaaccatagaattgccg ttgaaactgggggggcttgagtatgtttgaggcaggcggaatgcgtggtgtagcggtgaaatgatagatatcacgcaga accccgattgcgaaggcagcctgccaagccatgactgacgctgatgcacgaaagcgtggggatcaaacaggattag ataccctggtagtccacgcagtaaacgatgatcactagctgtttgcgatacagtgtaagcggcacagcgaaagcgttaa gtgatccacctggggagtacgccggcaacggtgaaactcaaaggaattgacgggggcccgcacaagcggaggaac atgtggtttaattcgatgatacgcgaggaaccttacccgggtttgaacgcattcggaccgaggtggaaacaccttttctag caatagccgtttgcgaggtgctgcatggttgtcgtcagctcgtgccgtgaggtgtcggcttaagtgccataacgagcgc aaccatgccactagttactaacaggtgatgctgaggactctggtgggactgccagcgtaagctgcgaggaaggcgg ggatgacgtcaaatcagcacggcccttacatccggggcgacacacgtgttacaatggcgtggacaaagggaagcca cctggcgacagggagcgaatccccaaaccacgtctcagttcggatcggagtctgcaacccgactccgtgaagctgga ttcgctagtaatcgcgcatcagccatggcgcggtgaatacgttcccgggccttgtacacaccgcccgtcaagccatgg gagccgggggtacctgaagtccgtaaccgaaaggatcggcctagggtaaaactggtgactggggctaagtcgtaaca aggtagccgtaccggaaggtgcggctggaacacctccttt |
| *Parabacteroides_ distasanis* | SEQ ID NO: 359 | cgaagagtttgatcctggctcaggatgaacgctagcgacaggcttaacacatgcaagtcgaggggcagcgggggtag caatacccgccggcgaccggcgcacgggtgagtaacgcgtatgcaacttacctatcagaggggggataacccggcga aagtcggactaataccgcatgaagcaggggccccgcatggggatatttgctaaagattcatcgctgatagataggcatg cgaccattaggcagaggcggggtaacggcccaccaaaccgacgatggataggggactgagaggaaggtcccccca cattggtactgagacacggaccaaactcctacgggaggcagcagtgaggaatattggtcaatgggcgcgagcctgaa ccagccaagtcgcgtgagggatgaaggttctatggatcgtaaacctcttttataagggaataaagtgcgggacgtgtcct gattgtatgtaccttatgaataaggatcggctaactccgtgccagcagccgcggtaatacggaggatccgagcgttatc cggatttattgggataaagggtgcgtaggcggcctataagtcagcggtgaaagtctgtggctcaaccatagaattgccg ttgaaactgggggggcttgagtatgtttgaggcaggcggaatgcgtggtgtagcggtgaaatgcttagatatcacgcaga accccgattgcgaaggcagcctgccaagccatgactgacgctgatgcacgaaagcgtggggatcaaacaggattag ataccctggtagtccacgcagtaaacgatgatcactagctgtttgcgatacagtgtaagcggcacagcgaaagcgttaa gtgatccacctggggagtacgccggcaacggtgaaactcaaaggaattgacgggggcccgcacaagcggaggaac atgtggtttaattcgatgatacgcgaggaaccttacccgggtttgaacgcattcggaccgaggtggaaacaccttttctag |

TABLE 6-continued

| Full length 16S rDNA sequences of species (positive correlates) | | |
|---|---|---|
| Species Name | Sequence Identifier | 16S sequence |
| | | caatagccgtttgcgaggtgctgcatggttgtcgtcagctcgtgccgtgaggtgtcggcttaagtgccataacgagcgc<br>aacccttgccactagttactaacaggtaatgctgaggactctggtgggactgccagcgtaagctgcgaggaaggcggg<br>gatgacgtcaaatcagcacggcccttacatccggggcgacacacgtgttacaatggcgtggacaaagggaggccac<br>ctggcgacagggagcgaatccccaaaccacgtctcagttcggatcggagtctgcaacccgactccgtgaagctggatt<br>cgctagtaatcgcgcatcagccatggcgcggtgaatacgttcccgggccttgtacacaccgcccgtcaagccatggga<br>gccgggggtacctgaagtccgtaaccgcgaggatcggcctagggtaaaactggtgactggggctaagtcgtaacaag<br>gtagccgtaccggaaggtgcggctggaacacctccat |
| *Parabacteroides_ distasanis* | SEQ ID NO: 360 | cgaagagtttgatcctggctcaggatgaacgctagcgacaggcttaacacatgcaagtcgaggggcagcacaggtag<br>caataccgggtggcgaccggcgcacgggtgagtaacgcgtatgcaacttacctatcagagggggataacccggcga<br>aagtcggactaataccgcatgaagcaggggtcccgcatggggatatttgctaaagattcatcgctgatagataggcatg<br>cgaccattaggcagaggcggggtaacggcccaccaaaccgacgatggatagggactgagaggaaggtcccccca<br>cattggtactgagacacggaccaaactcctacgggaggcagcagtgaggaatattggtcaatgggcgtaagcctgaa<br>ccagccaagtcgcgtgagggatgaaggactatggatcgtaaacctctatataagggaataaagtgcgggacgtgtcct<br>gattgtatgtaccttatgaataaggatcggctaactccgtgccagcagccgcggtaatacggaggatccgagcgttatc<br>cggatttattgggataaagggtgcgtaggcggcctataagtcagcggtgaaagtctgtggctcaaccatagaattgccg<br>ttgaaactgggggggcttgagtatgatgaggcaggcggaatgcgtggtgtagcggtgaaatgatagatatcacgcaga<br>accccgattgcgaaggcagcctgccaagccatgactgacgctgatgcacgaaagcgtggggatcaaacaggattag<br>ataccctggtagtccacgcagtaaacgatgatcactagctgatgcgatacagtgtaagcggcacagcgaaagcgttaa<br>gtgatccacctggggagtacgccggcaacggtgaaactcaaaggaattgacgggggcccgcacaagcggaggaac<br>atgtggataattcgatgatacgcgaggaaccttacccgggtagaacgcattcggaccgaggtggaaacaccattctag<br>caatagccgtttgcgaggtgctgcatggttgtcgtcagctcgtgccgtgaggtgtcggcttaagtgccataacgagcgc<br>aaccatgccactagttactaacaggtaaagctgaggactctggtgggactgccagcgtaagctgcgaggaaggcgg<br>ggatgacgtcaaatcagcacggcccttacatccggggcgacacacgtgttacaatggcgtggacaaagggaagcca<br>cctggcgacagggagcgaatccccaaaccacgtctcagttcggatcggagtctgcaacccgactccgtgaagctgga<br>ttcgctagtaatcgcgcatcagccatggcgcggtgaatacgttcccgggccttgtacacaccgcccgtcaagccatgg<br>gagccgggggtacctgaagtccgtaaccgcgaggatcggcctagggtaaaactggtgactggggctaagtcgtaaca<br>aggtagccgtaccggaaggtgcggctggaacacctccat |
| *Citrobacter_freundii* | SEQ ID NO: 361 | attggagagatgatcctggctcaggacgaacgctggcggcgtgcctaatacatgcaagtcgagcgagtcccacggg<br>ggctagcggcggacgggtgagtaacacgtaggcaacctgcctctcagactgggataacatagggaaacttatgctaat<br>accggataggtttaggatcgcatgatctgaaaagaaaagatggcttttcgctatcactgggagatgggcctgcggcgca<br>ttagctagttggtggggtaacggcctaccaaggcgacgatgcgtagccgacctgagagggtgaccggccacactgg<br>gactgagacacggcccagactcctacgggaggcagcagtagggaattttccacaatggacgaaagtctgatggagca<br>acgccgcgtgaacgatgaaggtcttcggattgtaaagactgttgtcagggacgaacacgtaccgttcgaatagggcgg<br>taccttgacggtacctgacgagaaagccacggctaactacgtgccagcagccgcggtaatacgtaggtggcaagcgtt<br>gtccggatttattgggcgtaaagcgcgcgcaggcggctatgtaagtctggtgttaaagcccggggctcaaccccggttc<br>gcatcggaaactgtgtagcttgagtgcagaagaggaaagcggtattccacgtgtagcggtgaaatgcgtagagatgtg<br>gaggaacaccagtggcgaaggcggctttctggtctgtaactgacgctgaggcgcgaaagcgtggggagcaaacagg<br>attagataccctggtagtccacgccgtaaacgatgagtgctaggtgttgggggtttcaataccctcagtgccgcagctaa<br>cgcaataagcactccgcctggggagtacgctcgcaagagtgaaactcaaaggaattgacgggggcccgcacaagcg<br>gtggagcatgtggtttaattcgaagcaacgcgaagaaccttaccaggtcttgacatcccgctgaccgctctggagacag<br>agcacccttcggggcagcggtgacaggtggtgcatggttgtcgtcagctcgtgtcgtgagatgttgggttaagtcccgc<br>aacgagcgcaacccttatctttagttgccagcattcagttgggcactctagagagactgccgtcgacaagacggaggaa<br>ggcggggatgacgtcaaatcatcatgccccttatgacctgggctacacacgtgctacaatggaggtacaacgggacg<br>ctacctcgcgagaggacgccaatctcttaaaaccaatctcagttcggattgtaggctgcaactcgcctacatgaagtcgg<br>aatcgctagtaatcgcggatcagcatgccgcggtgaatacgttcccgggccttgtacacaccgcccgtcacaccacgg |

TABLE 6-continued

Full length 16S rDNA sequences of species (positive correlates)

| Species Name | Sequence Identifier | 16S sequence |
|---|---|---|
| | | gagtttgcaacacccgaagtcggtgaggtaaccgcaaggagccagccgccgaaggtggggtagatgactggggtga agtcgtaacaaggtatccgtaccggaaggtgcggatggatcacctccat |
| *Citrobacter_freundii* | SEQ ID NO: 362 | ttgaagagtttgatcatggctcagattgaacgctggcggcaggcctaacacatgcaagtcgaacggtagcacagagga gcttgctcatgggtgacgagtggcggacgggtgagtaatgtctgggaaactgcccgatggagggggataactactgg aaacggtagctaataccgcataacgtcgcaagaccaaagagggggaccttcgggcctcttgccatcggatgtgccca gatgggattagctagtaggtggggtaacggctcacctaggcgacgatccctagctggtctgagaggatgaccagcca cactggaactgagacacggtccagactcctacgggaggcagcagtggggaatattgcacaatgggcgcaagcctgat gcagccatgccgcgtgtatgaagaaggccttcgggttgtaaagtactttcagcgaggaggaaggcgttgtggttaataa ccgcagcgattgacgttactcgcagaagaagcaccggctaactccgtgccagcagccgcggtaatacggagggtgc aagcgttaatcggaattactgggcgtaaagcgcacgcaggcggtctgtcaagtcggatgtgaaatccccgggctcaac ctgggaactgcatccgaaactggcaggctagagtcttgtagaggggggtagaattccaggtgtagcggtgaaatgcgt agagatctggaggaataccggtggcgaaggcggccccctggacaaagactgacgctcaggtgcgaaagcgtgggg agcaaacaggattagataccctggtagtccacgccgtaaacgatgtcgacttggaggttgtgcccttgaggcgtggctt ccggagctaacgcgttaagtcgaccgcctggggagtacggccgcaaggttaaaactcaaatgaattgacgggggccc gcacaagcggtggagcatgtggtttaattcgatgcaacgcgaagaaccttacctactatgacatccagagaacttagca gagatgctttggtgccttcgggaactctgagacaggtgctgcatggctgtcgtcagctcgtgttgtgaaatgttgggttaa gtcccgcaacgagcgcaacccttatcctttgagccagcggacggccgggaactcaaaggagactgccagtgataaa ctggaggaaggtggggatgacgtcaagtcatcatggcccttacgagtagggctacacacgtgctacaatggcatatac aaagagaagcgacctcgcgagagcaagcggacctcataaagtatgtcgtagtccggattggagtctgcaactcgactc catgaagtcggaatcgctagtaatcgtggatcagaatgccacggtgaatacgacccgggccttgtacacaccgcccgt cacaccatgggagtgggttgcaaaagaagtaggtagataaccttcgggagggcgcttaccactttgtgattcatgactg gggtgaagtcgtaacaaggtaaccgtaggggaacctgcggttggatcacctcctt |
| *Lactococcus_lactis* | SEQ ID NO: 363 | atttgagagtttgatcctggctcaggacgaacgctggcggcgtgcctaatacatgcaagttgagcgctgaaggttggta cttgtaccgactggatgagcagcgaacgggtgagtaacgcgtggggaatctgcctttgagcgggggacaacatttgga aacgaatgctaataccgcataaaaactttaaacacaagttttaagtttgaaagatgcaattgcatcactcaaagatgatccc gcgttgtattagctagttggtgaggtaaaggctcaccaaggcgatgatacatagccgacctgagagggtgatcggcca cattgggactgagacacggcccaaactcctacgggaggcagcagtagggaatcttcggcaatggacgaaagtctgac cgagcaacgccgcgtgagtgaagaaggttttcggatcgtaaaactctgaggtagagaagaacgaggtgagagtgga aagctcatcaagtgacggtaactacccagaaagggacggctaactacgtgccagcagccgcggtaatacgtaggtcc cgagcgttgtccggatttattgggcgtaaagcgagcgcaggtggtttattaagtctggtgtaaaaggcagtggctcaacc attgtatgcattggaaactggtagacttgagtgcaggagaggagagtggaattccatgtgtagcggtgaaatgcgtagat atatggaggaacaccggtggcgaaagcggctctctggcctgtaactgacactgaggctcgaaagcgtggggagcaa acaggattagataccctggtagtccacgccgtaaacgatgagtgctagatgtagggagctataagttctctgtatcgcag ctaacgcaataagcactccgcctggggagtacgaccgcaaggttgaaactcaaaggaattgacgggggcccgcaca agcggtggagcatgtggtttaattcgaagcaacgcgaagaaccttaccaggtcttgacatactcgtgctattcctagaga taggaagttccttcgggacacgggatacaggtggtgcatggttgtcgtcagctcgtgtcgtgagatgttgggttaagtcc cgcaacgagcgcaacccctattgttagttgccatcattaagttgggcactctaacgagactgccggtgataaaccggag gaaggtggggatgacgtcaaatcatcatgccccttatgacctgggctacacacgtgctacaatggatggtacaacgagt cgcgagacagtgatgtttagctaatctataaaaccattctcagttcggattgtaggctgcaactcgcctacatgaagtcg gaatcgctagtaatcgcggatcagcacgccgcggtgaatacgttcccgggccttgtacacaccgcccgtcacaccacg ggagttgggagtacccgaagtaggttgcctaaccgcaaggagggcgcttcctaaggtaagaccgatgactggggtga agtcgtaacaaggtagccgtatcggaaggtgcggctggatcacctcctt |

TABLE 6-continued

Full length 16S rDNA sequences of species (positive correlates)

| Species Name | Sequence Identifier | 16S sequence |
|---|---|---|
| *Lactococcus_lactis* | SEQ ID NO: 364 | atttgagagtttgatcctggctcaggacgaacgctggcggcgtgcctaatacatgcaagttgagcgctgaaggttggta<br>cttgtaccgactggatgagcagcgaacgggtgagtaacgcgtggggaatctgcctttgagcgggggacaacatttgga<br>aacgaatgctaataccgcataaaaactttaaacacaagttttaagtttgaaagatgcaattgcatcactcaaagatgatccc<br>gcgttgtattagctagttggtgaggtaaaggctcaccaaggcgatgatacatagccgacctgagagggtgatcggcca<br>cattgggactgagacacggcccaaactcctacgggaggcagcagtagggaatcttcggcaatggacgaaagtctgac<br>cgagcaacgccgcgtgagtgaagaaggtatcggatcgtaaaactctgaggtagagaagaacgdggtgagagtgga<br>aagctcatcaagtgacggtaactacccagaaagggacggctaactacgtgccagcagccgcggtaatacgtaggtcc<br>cgagcgttgtccggatttattgggcgtaaagcgagcgcaggtggtttattaagtctggtgtaaaaggcagtggctcaacc<br>attgtatgcattggaaactggtagacttgagtgcaggagaggagagtggaattccatgtgtagcggtgaaatgcgtagat<br>atatggaggaacaccggtggcgaaagcggctctctggcctgtaactgacactgaggctcgaaagcgtggggagcaa<br>acaggattagataccctggtagtccacgccgtaaacgatgagtgctagatgtagggagctataagttctctgtatcgcag<br>ctaacgcaataagcactccgcctggggagtacgaccgcaaggttgaaactcaaaggaattgacgggggcccgcaca<br>agcggtggagcatgtggtttaattcgaagcaacgcgaagaaccttaccaggtcttgacatactcgtgctattcctagaga<br>taggaagttccttcgggacacgggatacaggtggtgcatggttgtcgtcagctcgtgtcgtgagatgttgggttaagtcc<br>cgcaacgagcgcaacccctattgdagagccatcattaagttgggcactctaacgagactgccggtgataaaccggag<br>gaaggtggggatgacgtcaaatcatcatgccccttatgacctgggctacacacgtgctacaatggatggtacaacgagt<br>cgcgagacagtgatgtttagctaatctcttaaaaccattctcagttcggattgtaggctgcaactcgcctacatgaagtcg<br>gaatcgctagtaatcgcggatcagcacgccgcggtgaatacgttcccgggccttgtacacaccgcccgtcacaccacg<br>ggagttgggagtacccgaagtaggttgcctaaccgcaaggagggcgcttcctaaggtaagaccgatgactggggtga<br>agtcgtaacaaggtagccgtatcggaaggtgcggctggatcacctcctt |
| *Alistipes_onderdonkii* | SEQ ID NO: 365 | atggagagtttgatcctggctcaggatgaacgctagcggcaggcctaacacatgcaagtcgaggggcatcgggattg<br>aagcttgcttcaattgccggcgaccggcgcacgggtgcgtaacgcgtatgtaacctacctataacaggggcataacact<br>gagaaattggtactaattccccataatattcggagaggcatctctccgggttgaaaactccggtggttatagatggacatg<br>cgttgtattagctagttggtgaggtaacggctcaccaaggcaacgatacatagggggactgagaggttaacccccccac<br>actggtactgagacacggaccagactcctacgggaggcagcagtgaggaatattggtcaatggacgcaagtctgaac<br>cagccatgccgcgtgcaggaagacggctctatgagagtaaactgcttagtacgagggtaaactcacctacgtgtaggt<br>gactgaaagtatcgtacgaataaggatcggctaactccgtgccagcagccgcggtaatacggaggattcaagcgttat<br>ccggatttattgggtttaaagggtgcgtaggcggtttgataagttagaggtgaaatcccggggcttaactccggaactgc<br>ctctaatactgttagactagagagtagagcggtaggcggaatgtatggtgtagcggtgaaatgcttagagatcatacag<br>aacaccgattgcgaaggcagcttaccaaactatatctgacgttgaggcacgaaagcgtggggagcaaacaggattag<br>ataccctggtagtccacgcagtaaacgatgataactcgdgtcggcgatacacagtcggtgactaagcgaaagcgataa<br>gttatccacctggggagtacgttcgcaagaatgaaactcaaaggaattgacgggggcccgcacaagcggaggaacat<br>gtggtttaattcgatgatacgcgaggaaccttacccgggcttgaaagttactgacgattctggaaacaggatttcccttcg<br>gggcaggaaactaggtgctgcatggagtcgtcagctcgtgccgtgaggtgtcgggttaagtcccataacgagcgcaa<br>cccctaccgttagttgccatcaggtcaagctgggcactctggcgggactgccggtgtaagccgagaggaaggtgggg<br>atgacgtcaaatcagcacggcccttacgtccggggctacacacgtgttacaatggtaggtacagagggtcgctacccc<br>gcgaggggatgccaatctcgaaagcctatctcagttcggattggaggctgaaacccgcctccatgaagttggattcgct<br>agtaatcgcgcatcagccatggcgcggtgaatacgttcccgggccttgtacacaccgcccgtcaagccatggaagctg<br>ggggtgcctgaagttcgtgaccgcaaggagcgacctagggcaaaaccggtaactggggctaagtcgtaacaaggta<br>gccgtaccggaaggtgcggctggaacacctccttt |
| *Alistipes_onderdonkii* | SEQ ID NO: 366 | atggagagtttgatcctggctcaggatgaacgctagcggcaggcctaacacatgcaagtcgaggggcatcgggattg<br>aagcttgatcaattgccggcgaccggcgcacgggtgcgtaacgcgtatgtaacctacctataacaggggcataacact<br>gagaaattggtactaattccccataatattcggagaggcatctctccgggttgaaaactccggtggttatagatggacatg<br>cgttgtattagctagttggtgaggtaacggctcaccaaggcaacgatacatagggggactgagaggttaacccccccac<br>actggtactgagacacggaccagactcctacgggaggcagcagtgaggaatattggtcaatggacgcaagtctgaac |

TABLE 6-continued

Full length 16S rDNA sequences of species (positive correlates)

| Species Name | Sequence Identifier | 16S sequence |
|---|---|---|
| | | cagccatgccgcgtgcaggaagacggctctatgagttgtaaactgcattgtacgagggtaaactcacctacgtgtaggt gactgaaagtatcgtacgaataaggatcggctaactccgtgccagcagccgcggtaatacggaggattcaagcgttat ccggatttattgggtttaaagggtgcgtaggcggtttgataagttagaggtgaaatcccggggcttaactccggaactgc ctctaatactgttagactagagagtagttgcggtaggcggaatgtatggtgtagcggtgaaatgcttagagatcatacag aacaccgattgcgaaggcagcttaccaaactatatctgacgttgaggcacgaaagcgtggggagcaaacaggattag ataccctggtagtccacgcagtaaacgatgataactcgdgtcggcgatacacagtcggtgactaagcgaaagcgataa gttatccacctggggagtacgttcgcaagaatgaaactcaaaggaattgacgggggcccgcacaagcggaggaacat gtggtttaattcgatgatacgcgaggaaccttacccgggcttgaaagttactgacgattctggaaacaggatttcccttcg gggcaggaaactaggtgctgcatggttgtcgtcagctcgtgccgtgaggtgtcgggttaagtcccataacgagcgcaa cccctaccgttagttgccatcaggtcaagctgggcactctggcgggactgccggtgtaagccgagaggaaggtgggg atgacgtcaaatcagcacggcccttacgtccggggctacacacgtgttacaatggtaggtacagagggtcgctacccc gcgaggggatgccaatctcgaaagcctatctcagttcggattggaggctgaaacccgcctccatgaagttggattcgct agtaatcgcgcatcagccatggcgcggtgaatacgttcccgggccttgtacacaccgcccgtcaagccatggaagctg gggtgcctgaagttcgtgaccgcaaggagcgacctagggcaaaaccggtaactggggctaagtcgtaacaaggta gccgtaccggaaggtgcggctggaacacctccttt |
| *Campylobacter_ curvus* | SEQ ID NO: 367 | atggagagtttgatcctggctcagagtgaacgctggcggcgtgcctaatacatgcaagtcgaacggacaagtaagagc ttgctcttatgagttagtggcgcacgggtgagtaatgtatagctaatctgccccatagtggaggacaacagttggaaacg actgctaatactccatactccatttatatataagtataaatgggaaagtcgaaccctatatattgtttatttatcaaatacctac ggcgcaaccgaaagttgcggtgtgattaggtgggtcaagggagcgtagctccttgtcgcaaagacggactttgttcgt ctgcgaagtaaataatatataggtttctcgctatgggatgaggctatatcgtatcagctagttggtaaggtaatggcttac caaggctatgacgcgtaactggtctgagaggatgatcagtcacactggaactgagacacggtccagactcctacggga ggcagcagtagggaatattgctcaatggggaaaccctgaagcagcaacgccgcgtggaggatgacactdtcggag cgtaaactccdttatggggaagaaatttgacggtacccaaggaataagcaccggctaactccgtgccagcagccgcg gtaatacggagggtgcaagcgttactcggaatcactgggcgtaaaggacgcgtaggcggattatcaagtctcttgtgaa atccaatggcttaaccattgaactgcttgagaaactgataatctagagtgagggagaggtagatggaattggtggtgtag ggtaaaatccgtagagatcaccaggaatacccattgcgaaggcgatctgctggaactcaactgacgctaatgcgtga aagcgtggggagcaaacaggattagataccctggtagtccacgccctaaacgatgtatactagttgttgctgagctagtc ttggcagtaatgcacctaacggattaagtataccgcctggggagtacggtcgcaagattaaaactcaaaggaatagacg gggacccgcacaagcggtggagcatgtggtttaattcgaagatacgcgaagaaccttacccggacttgatatctaacaa atcatctagagatagaagagtgtctgcttgcagaaatgttaagacaggtgctgcacggctgtcgtcagctcgtgtcgtga gatgttgggttaagtcccgcaacgagcgcaacccacgtcattagttgctaacggttcggccgagcactctaatgagact gcatcgcaaggaggaggaaggtgtggacgacgtcaagtcatcatggccatatgtccggggcgacacacgtgctac aatggcgtatacaatgagacgcaatatcgcgagatggagcaaatctataaaatacgtcccagttcggattggagtctgc aactcgactccatgaagccggaatcgctagtaatcgtagatcagccatgctacggtgaatacgttcccgggtcagtact caccgcccgtcacaccatgggagttgatttcactcgaagcccaaataccaaaccggttatggtccacagtggaatcagc gactggggtgaagtcgtaacaaggtaaccgtaggagaacctgcggdggatcacctcctt |
| *Lactobacillus_ fermentum* | SEQ ID NO: 368 | tatgagagtttgatcctggctcaggatgaacgccggcggtgtgcctaatacatgcaagtcgaacgcgttggcccgattg attgatggtgcttgcacctgattgattttggtcgccaacgagtggcggacgggtgagtaacacgtaggtaacctgccca gaagcgggggacaacatttggaaacagatgctaataccgcataacaacgttgttcgcatgaacaacgcttaaaagatg gatctcgctatcacttctggatggacctgcggtgcattagcttgaggtggggtaacggcctaccaaggcgatgatgcat agccgagttgagagactgatcggccacaatgggactgagacacggcccatactcctacgggaggcagcagtaggga atcttccacaatgggcgcaagcctgatggagcaacaccgcgtgagtgaagaagggtttcggctcgtaaagctctgttgt taaagaagaacacgtatgagagtaactgttcatacgttgacggtatttaaccagaaagtcacggctaactacgtgccagc agccgcggtaatacgtaggtggcaagcgttatccggatttattgggcgtaaagagagtgcaggcggttttctaagtctga tgtgaaagccttcggcttaaccggagaagtgcatcggaaactggataacttgagtgcagaagagggtagtggaactcc atgtgtagcggtggaatgcgtagatatatggaagaacaccagtggcgaaggcggctacctggtctgcaactgacgctg |

TABLE 6-continued

Full length 16S rDNA sequences of species (positive correlates)

| Species Name | Sequence Identifier | 16S sequence |
|---|---|---|
| | | agactcgaaagcatgggtagcgaacaggattagataccctggtagtccatgccgtaaacgatgagtgctaggtgagg<br>agggtttccgcccttcagtgccggagctaacgcattaagcactccgcctggggagtacgaccgcaaggttgaaactca<br>aaggaattgacgggggcccgcacaagcggtggagcatgtggtttaattcgaagctacgcgaagaaccttaccaggtct<br>tgacatcttgcgccaaccctagagatagggcgtttccttcgggaacgcaatgacaggtggtgcatggtcgtcgtcagct<br>cgtgtcgtgagatgagggttaagtcccgcaacgagcgcaacccagttactagttgccagcattaagttgggcactctag<br>tgagactgccggtgacaaaccggaggaaggtggggacgacgtcagatcatcatgccccttatgacctgggctacaca<br>cgtgctacaatggacggtacaacgagtcgcgaactcgcgagggcaagcaaatctcttaaaaccgttctcagttcggact<br>gcaggctgcaactcgcctgcacgaagtcggaatcgctagtaatcgcggatcagcatgccgcggtgaatacgttcccg<br>ggccagtacacaccgcccgtcacaccatgagagtagtaacacccaaagtcggtggggtaaccattaggagccagcc<br>gcctaaggtgggacagatgattagggtgaagtcgtaacaaggtagccgtaggagaacctgcggctggatcacctcctt<br>t |
| *Lactobacillus_ fermentum* | SEQ ID NO: 369 | tatgagagtttgatcctggctcaggatgaacgccggcggtgtgcctaatacatgcaagtcgaacgcgttggcccaattg<br>attgacggtgcttgcacctgattgattaggtcgccaacgagtggcggacgggtgagtaacacgtaggtaacctgccca<br>gaagcgggggacaacatttggaaacagatgctaataccgcataacaacgttgttcgcatgaacaacgcttaaaagatg<br>gatctcgctatcacttctggatggacctgcggtgcattagcttgaggtggggtaacggcctaccaaggcgatgatgcat<br>agccgagttgagagactgatcggccacaatgggactgagacacggcccatactcctacgggaggcagcagtaggga<br>atcttccacaatgggcgcaagcctgatggagcaacaccgcgtgagtgaagaagggtttcggctcgtaaagctctgttgt<br>taaagaagaacacgtatgagagtaactgacatacgttgacggtatttaaccagaaagtcacggctaactacgtgccagc<br>agccgcggtaatacgtaggtggcaagcgttatccggatttattgggcgtaaagagagtgcaggcggattctaagtctga<br>tgtgaaagccacggcttaaccggagaagtgcatcggaaactggataacttgagtgcagaagagggtagtggaactcc<br>atgtgtagcggtggaatgcgtagatatatggaagaacaccagtggcgaaggcggctacctggtctgcaactgacgctg<br>agactcgaaagcatgggtagcgaacaggattagataccctggtagtccatgccgtaaacgatgagtgctaggtgagg<br>agggtttccgcccttcagtgccggagctaacgcattaagcactccgcctggggagtacgaccgcaaggttgaaactca<br>aaggaattgacgggggcccgcacaagcggtggagcatgtggtttaattcgaagctacgcgaagaaccttaccaggtct<br>tgacatcttgcgccaaccctagagatagggcgtaccacgggaacgcaatgacaggtggtgcatggtcgtcgtcagct<br>cgtgtcgtgagatgagggttaagtcccgcaacgagcgcaacccagttactagttgccagcattaagttgggcactctag<br>tgagactgccggtgacaaaccggaggaaggtggggacgacgtcagatcatcatgccccttatgacctgggctacaca<br>cgtgctacaatggacggtacaacgagtcgcgaactcgcgagggcaagcaaatctataaaaccgttctcagttcggact<br>gcaggctgcaactcgcctgcacgaagtcggaatcgctagtaatcgcggatcagcatgccgcggtgaatacgttcccg<br>ggccagtacacaccgcccgtcacaccatgagagtagtaacacccaaagtcggtggggtaaccattaggagccagcc<br>gcctaaggtgggacagatgattagggtgaagtcgtaacaaggtagccgtaggagaacctgcggctggatcacctcctt<br>t |
| *Lactobacillus_ fermentum* | SEQ ID NO: 370 | tatgagagtttgatcctggctcaggatgaacgccggcggtgtgcctaatacatgcaagtcgaacgcgttggcccaattg<br>attgatggtgcttgcacctgattgattttggtcgccaacgagtggcggacgggtgagtaacacgtaggtaacctgccca<br>gaagcgggggacaacatttggaaacagatgctaataccgcataacaacgttgttcgcatgaacaacgcttaaaagatg<br>gatctcgctatcacttctggatggacctgcggtgcattagcttgaggtggggtaacggcctaccaaggcgatgatgcat<br>agccgagttgagagactgatcggccacaatgggactgagacacggcccatactcctacgggaggcagcagtaggga<br>atcttccacaatgggcgcaagcctgatggagcaacaccgcgtgagtgaagaagggtttcggctcgtaaagctctgttgt<br>taaagaagaacacgtatgagagtaactgttcatacgttgacggtatttaaccagaaagtcacggctaactacgtgccagc<br>agccgcggtaatacgtaggtggcaagcgttatccggatttattgggcgtaaagagagtgcaggcggattctaagtctga<br>tgtgaaagccttcggcttaaccggagaagtgcatcggaaactggataacttgagtgcagaagagggtagtggaactcc<br>atgtgtagcggtggaatgcgtagatatatggaagaacaccagtggcgaaggcggctacctggtctgcaactgacgctg<br>agactcgaaagcatgggtagcgaacaggattagataccctggtagtccatgccgtaaacgatgagtgctaggtgttgg<br>agggtttccgcccttcagtgccggagctaacgcattaagcactccgcctggggagtacgaccgcaaggttgaaactca<br>aaggaattgacgggggcccgcacaagcggtggagcatgtggtttaattcgaagctacgcgaagaaccttaccaggtct<br>tgacatcttgcgccaaccctagagatagggcgtttccttcgggaacgcaatgacaggtggtgcatggtcgtcgtcagct |

TABLE 6-continued

| Full length 16S rDNA sequences of species (positive correlates) | | |
|---|---|---|
| Species Name | Sequence Identifier | 16S sequence |
| | | cgtgtcgtgagatgagggttaagtcccgcaacgagcgcaacccagttactagttgccagcattaagagggcactctag tgagactgccggtgacaaaccggaggaaggtggggacgacgtcagatcatcatgccccttatgacctgggctacaca cgtgctacaatggacggtacaacgagtcgcgaactcgcgagggcaagcaaatctataaaaccgttctcagttcggact gcaggctgcaactcgcctgcacgaagtcggaatcgctagtaatcgcggatcagcatgccgcggtgaatacgttcccg ggccttgtacacaccgcccgtcacaccatgagagtttgtaacacccaaagtcggtggggtaacctttttaggagccagcc gcctaaggtgggacagatgattagggtgaagtcgtaacaaggtagccgtaggagaacctgcggctggatcacctcctt t |
| *Lactobacillus_ fermentum* | SEQ ID NO: 371 | tatgagagtttgatcctggctcaggatgaacgccggcggtgtgcctaatacatgcaagtcgaacgcgttggtccaattga ttgacggtgatgcacctgattgattaggtcgccaacgagtggcggacgggtgagtaacacgtaggtaacctgcccag aagcgggggacaacatttggaaacagatgctaataccgcataacaacgttgttcgcatgaacaacgtttaaaagatggc actcgctatcacttctggatggacctgcggtgcattagcttgaggtggggtaatggcctaccaaggcgatgatgcatag ccgagttgagagactgatcggccacaatgggactgagacacggcccatactcctacgggaggcagcagtagggaat cttccacaatgggcgcaagcctgatggagcaacaccgcgtgagtgaagaagggtacggctcgtaaagctctgagtta aagaagaacacgtatgagagtaactgttcatacgttgacggtatttaaccagaaagtcacggctaactacgtgccagca gccgcggtaatacgtaggtggcaagcgttatccggatttattgggcgtaaagagagtgcaggcggattctaagtctgat gtgaaagccttcggcttaaccggagaagtgcatcggaaactggataacttgagtgcagaagagggtagtggaactcca tgtgtagcggtggaatgcgtagatatatggaagaacaccagtggcgaaggcggctacctggtctgcaactgacgctga gactcgaaagcatgggtagcgaacaggattagataccctggtagtccatgccgtaaacgatgagtgctaggtgttgga gggtttccgcccttcagtgccggagctaacgcattaagcactccgcctggggagtacgaccgcaaggttgaaactcaa aggaattgacgggggcccgcacaagcggtggagcatgtggtttaattcgaagctacgcgaagaaccttaccaggtctt gacatcttgcgccaaccctagagatagggcgatccttcgggaacgcaatgacaggtggtgcatggtcgtcgtcagctc gtgtcgtgagatgagggttaagtcccgcaacgagcgcaacccagttactagagccagcattaagagggcactctagt gagactgccggtgacaaaccggaggaaggtggggacgacgtcagatcatcatgccccttatgacctgggctacacac gtgctacaatggacggtacaacgagtcgcaaactcgcgagggcaagcaaatctataaaaccgttctcagttcggactg caggctgcaactcgcctgcacgaagtcggaatcgctagtaatcgcggatcagcatgccgcggtgaatacgttcccgg gccttgtacacaccgcccgtcacaccatgagagtttgtaacacccaaagtcggtggggtaacctttttaggagccagccg cctaaggtgggacagatgattagggtgaagtcgtaacaaggtagccgtaggagaacctgcggctggatcacctcctt |
| *Lactobacillus_ fermentum* | SEQ ID NO: 372 | tatgagagtttgatcctggctcaggatgaacgccggcggtgtgcctaatacatgcaagtcgaacgcgttggcccaattg attgatggtgcttgcacctgattgattaggtcgccaacgagtggcggacgggtgagtaacacgtaggtaacctgccca gaagcgggggacaacatttggaaacagatgctaataccgcataacaacgttgttcgcatgaacaacgcttaaaagatg gatctcgctatcacttctggatggacctgcgctgcattagcttgaggtggggtaatggcctaccaaggcgatgatgcat agccgagttgagagactgatcggccacaatgggactgagacacggcccatactcctacgggaggcagcagtaggga atcttccacaatgggcgcaagcctgatggagcaacaccgcgtgagtgaagaagggatcggctcgtaaagctctgagt taaagaagaacacgtatgagagtaactgttcatacgttgacggtatttaaccagaaagtcacggctaactacgtgccagc agccgcggtaatacgtaggtggcaagcgttatccggatttattgggcgtaaagagagtgcaggcggattctaagtctga tgtgaaagccttcggcttaaccggagaagtgcatcggaaactggataacttgagtgcagaagagggtagtggaactcc atgtgtagcggtggaatgcgtagatatatggaagaacaccagtggcgaaggcggctacctggtctgcaactgacgag agactcgaaagcatgggtagcgaacaggattagataccctggtagtccatgccgtaaacgatgagtgctaggtgttgg agggatccgcccttcagtgccggagctaacgcattaagcactccgcctggggagtacgaccgcaaggttgaaactca aaggaattgacgggggcccgcacaagcggtggagcatgtggtttaattcgaagctacgcgaagaaccttaccaggtct tgacatcttgcgccaaccctagagatagggcgtttccttcgggaacgcaatgacaggtggtgcatggtcgtcgtcagct cgtgtcgtgagatgagggttaagtcccgcaacgagcgcaacccagttactagttgccagcattaagttgggcactctag tgagactgccggtgacaaaccggaggaaggtggggacgacgtcagatcatcatgccccttatgacctgggctacaca cgtgctacaatggacggtacaacgagtcgcgaactcgtgagggcaagcaaatctcttaaaaccgttctcagttcggact gcaggctgcaactcgcctgcacgaagtcggaatcgctagtaatcgcggatcagcatgccgcggtgaatacgttcccg |

TABLE 6-continued

Full length 16S rDNA sequences of species (positive correlates)

| Species Name | Sequence Identifier | 16S sequence |
|---|---|---|
| | | ggccagtacacaccgcccgtcacaccatgagagtagtaacacccaaagtcggtggggtaaccattaggagccagcc<br>gcctaaggtgggacagatgattagggtgaagtcgtaacaaggtagccgtaggagaacctgcggctggatcacctcctt |
| *Bacteroides_ thetaiotaomicron* | SEQ ID NO: 373 | ctgaaccagccaagtagcgtgaaggatgactgccctatgggagtaaacttctatatatgggaataaagtatccacgtgt<br>ggaattttgtatgtaccatatgaataaggatcggctaactccgtgccagcagccgcggtaatacggaggatccgagcgt<br>tatccggatttattgggataaagggagcgtaggtggacagttaagtcagagtgaaagtagcggctcaaccgtaaaatt<br>gcagttgatactggctgtatgagtacagtagaggtgggcggaattcgtggtgtagcggtgaaatgcttagatatcacga<br>agaactccgattgcgaaggcagctcactggactgcaactgacactgatgctcgaaagtgtgggtatcaaacaggatta<br>gataccctggtagtccacacagtaaacgatgaatactcgctgtttgcgatatacagtaagcggccaagcgaaagcatta<br>agtattccacctggggagtacgccggcaacggtgaaactcaaaggaattgacgggggcccgcacaagcggaggaa<br>catgtggtttaattcgatgatacgcgaggaaccttacccgggcttaaattgcatttgaatatattggaaacagtatagccgt<br>aaggcaaatgtgaaggtgctgcatggttgtcgtcagctcgtgccgtgaggtgtcggcttaagtgccataacgagcgcaa<br>cccttatctttagttactaacaggtcatgctgaggactctagagagactgccgtcgtaagatgtgaggaaggtggggatg<br>acgtcaaatcagcacggcccttacgtccggggctacacacgtgttacaatgggggtacagaaggcagctacctggt<br>gacaggatgctaatcccaaaagcctctctcagttcggatcgaagtctgcaacccgacttcgtgaagctggattcgctagt<br>aatcgcgcatcagccatggcgcggtgaatacgttcccgggccttgtacacaccgcccgtcaagccatgaaagccggg<br>ggtacctgaagtacgtaaccgcaaggagcgtcctagggtaaaactggtaattggggctaagtcgtaacaaggtagccg<br>taccggaaggtgcggctggaacacctcctt |
| *Bacteroides_ thetaiotaomicron* | SEQ ID NO: 374 | ctgaaccagccaagtagcgtgaaggatgactgccctatgggagtaaacttatttatatgggaataaagtatccacgtgt<br>ggaattttgtatgtaccatatgaataaggatcggctaactccgtgccagcagccgcggtaatacggaggatccgagcgt<br>tatccggatttattgggataaagggagcgtaggtggacagttaagtcagagtgaaagtttgcggctcaaccgtaaaatt<br>gcagttgatactggctgtatgagtacagtagaggtgggcggaattcgtggtgtagcggtgaaatgcttagatatcacga<br>agaactccgattgcgaaggcagctcactggactgcaactgacactgatgctcgaaagtgtgggtatcaaacaggatta<br>gataccctggtagtccacacagtaaacgatgaatactcgctgtttgcgatatacagtaagcggccaagcgaaagcatta<br>agtattccacctggggagtacgccggcaacggtgaaactcaaaggaattgacgggggcccgcacaagcggaggaa<br>catgtggtttaattcgatgatacgcgaggaaccttacccgggcttaaattgcatttgaatatattggaaacagtatagccgt<br>aaggcaaatgtgaaggtgctgcatggttgtcgtcagctcgtgccgtgaggtgtcggcttaagtgccataacgagcgcaa<br>cccttatctttagttactaacaggtcatgctgaggactctagagagactgccgtcgtaagatgtgaggaaggtggggatg<br>acgtcaaatcagcacggcccttacgtccggggctacacacgtgttacaatgggggtacagaaggcagctacctggt<br>gacaggatgctaatcccaaaagcctctctcagttcggatcgaagtctgcaacccgacttcgtgaagctggattcgctagt<br>aatcgcgcatcagccatggcgcggtgaatacgttcccgggccttgtacacaccgcccgtcaagccatgaaagccggg<br>ggtacctgaagtacgtaaccgcaaggagcgtcctagggtaaaactggtaattggggctaagtcgtaacaaggtagccg<br>taccggaaggtgcggctggaacacctcctt |
| *Bacteroides_ thetaiotaomicron* | SEQ ID NO: 375 | atgaagagtttgatcctggctcaggatgaacgctagctacaggcttaacacatgcaagtcgaggggcagcatttcagttt<br>gcttgcaaactggagatggcgaccggcgcacgggtgagtaacacgtatccaacctgccgataactcggggatagcct<br>ttcgaaagaaagattaatacccgatagtataattagaccgcatggtcttattattaaagaatttcggttatcgatggggatgc<br>gttccattaggcagttggtgaggtaacggctcaccaaaccttcgatggataggggttctgagaggaaggtcccccacat<br>tggaactgagacacggtccaaactcctacgggaggcagcagtgaggaatattggtcaatggacgagagtctgaacca<br>gccaagtagcgtgaaggatgactgccctatgggagtaaacttctatatatgggaataaagattccacgtgtggaattttg<br>tatgtaccatatgaataaggatcggctaactccgtgccagcagccgcggtaatacggaggatccgagcgttatccggat<br>ttattgggtttaaagggagcgtaggtggacagttaagtcagttgtgaaagtttgcggctcaaccgtaaaattgcagttgat<br>actggctgtcttgagtacagtagaggtgggcggaattcgtggtgtagcggtgaaatgcttagatatcacgaagaactcc<br>gattgcgaaggcagctcactggactgcaactgacactgatgctcgaaagtgtgggtatcaaacaggattagataccctg<br>gtagtccacacagtaaacgatgaatactcgctgtttgcgatatacagtaagcggccaagcgaaagcattaagtattccac<br>ctggggagtacgccggcaacggtgaaactcaaaggaattgacgggggcccgcacaagcggaggaacatgtggttta<br>attcgatgatacgcgaggaaccttacccgggcttaaattgcatttgaatatattggaaacagtatagccgtaaggcaaatg |

TABLE 6-continued

Full length 16S rDNA sequences of species (positive correlates)

| Species Name | Sequence Identifier | 16S sequence |
|---|---|---|
| | | tgaaggtgctgcatggttgtcgtcagctcgtgccgtgaggtgtcggcttaagtgccataacgagcgcaacccttatcttta<br>gttactaacaggtcatgctgaggactctagagagactgccgtcgtaagatgtgaggaaggtggggatgacgtcaaatc<br>agcacggcccttacgtccggggctacacacgtgttacaatgggggtacagaaggcagctacctggtgacaggatgc<br>taatcccaaaagcctctctcagttcggatcgaagtctgcaacccgacttcgtgaagctggattcgctagtaatcgcgcatc<br>agccatggcgcggtgaatacgttcccgggccttgtacacaccgcccgtcaagccatgaaagccgggggtacctgaag<br>tacgtaaccgcaaggagcgtcctagggtaaaactggtaattggggctaagtcgtaacaaggtagccgtaccggaaggt<br>gcggctggaacacctcctt |
| *Bacteroides_ thetaiotaomicron* | SEQ ID NO: 376 | atgaagagtttgatcctggctcaggatgaacgctagctacaggcttaacacatgcaagtcgaggggcagcatttcagttt<br>gcttgcaaactggagatggcgaccggcgcacgggtgagtaacacgtatccaacctgccgataactcggggatagcct<br>ttcgaaagaaagattaatacccgatggtataattagaccgcatggtcttgttattaaagaatttcggttatcgatggggatg<br>cgttccattaggcagttggtgaggtaacggctcaccaaaccttcgatggataggggttctgagaggaaggtcccccaca<br>ttggaactgagacacggtccaaactcctacgggaggcagcagtgaggaatattggtcaatgggcgcaggcctgaacc<br>agccaagtagcgtgaaggatgactgccctatgggttgtaaacttcttttatatgggaataaagttttccacgtgtggaatttt<br>gtatgtaccatatgaataaggatcggctaactccgtgccagcagccgcggtaatacggaggatccgagcgttatccgg<br>atttattgggtttaaagggagcgtaggtggacagttaagtcagttgtgaaagtttgcggctcaaccgtaaaattgcagttg<br>atactggctgtcttgagtacagtagaggtgggcggaattcgtggtgtagcggtgaaatgcttagatatcacgaagaactc<br>cgattgcgaaggcagctcactggactgcaactgacactgatgctcgaaagtgtgggtatcaaacaggattagataccct<br>ggtagtccacacagtaaacgatgaatactcgctgtttgcgatatacagtaagcggccaagcgaaagcattaagtattcca<br>cctggggagtacgccggcaacggtgaaactcaaaggaattgacgggggcccgcacaagcggaggaacatgtggttt<br>aattcgatgatacgcgaggaaccttacccgggcttaaattgcatttgaatatattggaaacagtatagccgtaaggcaaat<br>gtgaaggtgctgcatggttgtcgtcagctcgtgccgtgaggtgtcggcttaagtgccataacgagcgcaacccttatcttt<br>agttactaacaggtcatgctgaggactctagagagactgccgtcgtaagatgtgaggaaggtggggatgacgtcaaat<br>cagcacggcccttacgtccggggctacacacgtgttacaatgggggtacagaaggcagctacctggtgacaggatg<br>ctaatcccaaaagcctctctcagttcggatcgaagtctgcaacccgacttcgtgaagctggattcgctagtaatcgcgcat<br>cagccatggcgcggtgaatacgttcccgggccttgtacacaccgcccgtcaagccatgaaagccgggggtacctgaa<br>gtacgtaaccgcaaggagcgtcctagggtaaaactggtaattggggctaagtcgtaacaaggtagccgtaccggaag<br>gtgcggctggaacacctcctt |
| *Lactobacillus_gasseri* | SEQ ID NO: 377 | atgagagtttgatcctggctcaggacgaacgctggcggcgtgcctaatacatgcaagtcgagcgagcttgcctagatg<br>aatttggtgcttgcaccaaatgaaactagatacaagcgagcggcggacgggtgagtaacacgtgggtaacctgcccaa<br>gagactgggataacacctggaaacagatgctaataccggataacaacactagacgcatgtctagagtttaaaagatggt<br>tctgctatcactcttggatggacctgcggtgcattagctagttggtaaggtaacggcttaccaaggcaatgatgcatagcc<br>gagttgagagactgatcggccacattgggactgagacacggcccaaactcctacgggaggcagcagtagggaatctt<br>ccacaatggacgcaagtctgatggagcaacgccgcgtgagtgaagaagggtttcggctcgtaaagctctgttggtagt<br>gaagaaagatagaggtagtaactggcctttatttgacggtaattacttagaaagtcacggctaactacgtgccagcagcc<br>gcggtaatacgtaggtggcaagcgttgtccggatttattgggcgtaaagcgagtgcaggcggttcaataagtctgatgt<br>gaaagccttcggctcaaccggagaattgcatcagaaactgttgaacttgagtgcagaagaggagagtggaactccatg<br>tgtagcggtggaatgcgtagatatatggaagaacaccagtggcgaaggcggctctctggtctgcaactgacgctgagg<br>ctcgaaagcatgggtagcgaacaggattagataccctggtagtccatgccgtaaacgatgagtgctaagtgttgggag<br>gtttccgcctctcagtgctgcagctaacgcattaagcactccgcctggggagtacgaccgcaaggttgaaactcaaagg<br>aattgacgggggcccgcacaagcggtggagcatgtggtttaattcgaagcaacgcgaagaaccttaccaggtcttgac<br>atccagtgcaaacctaagagattaggagttcccttcggggacgctgagacaggtggtgcatggctgtcgtcagctcgtg<br>tcgtgagatgttgggttaagtcccgcaacgagcgcaacccttgtcattagttgccatcattaagttgggcactctaatgag<br>actgccggtgacaaaccggaggaaggtggggatgacgtcaagtcatcatgcccatatgacctgggctacacacgtg<br>ctacaatggacggtacaacgagaagcgaacctgcgaaggcaagcggatctctgaaagccgttctcagttcggactgta<br>ggctgcaactcgcctacacgaagctggaatcgctagtaatcgcggatcagcacgccgcggtgaatacgttcccgggc |

TABLE 6-continued

Full length 16S rDNA sequences of species (positive correlates)

| Species Name | Sequence Identifier | 16S sequence |
|---|---|---|
| | | cttgtacacaccgcccgtcacaccatgagagtctgtaacacccaaagccggtgggataacctttataggagtcagccgt ctaaggtaggacagatgattagggtgaagtcgtaacaaggtagccgtaggagaacctgcggctggatcacctccttt |
| *Lactobacillus_casei_ paracasei* | SEQ ID NO: 378 | tatgagagtttgatcctggctcaggatgaacgctggcggcgtgcctaatacatgcaagtcgaacgagttctcgttgatga tcggtgcttgcaccgagattcaacatggaacgagtggcggacgggtgagtaacacgtgggtaacctgcccttaagtgg gggataacatttggaaacagatgctaataccgcatagatccaagaaccgcatggttcttggctgaaagatggcgtaagc tatcgcttttggatggacccgcggcgtattagctagttggtgaggtaatggctcaccaaggcgatgatacgtagccgaac tgagaggttgatcggccacattgggactgagacacggcccaaactcctacgggaggcagcagtagggaatcttccac aatggacgcaagtctgatggagcaacgccgcgtgagtgaagaaggctttcgggtcgtaaaactctgttgttggagaag aatggtcggcagagtaactgttgtcggcgtgacggtatccaaccagaaagccacggctaactacgtgccagcagccg cggtaatacgtaggtggcaagcgttatccggatttattgggcgtaaagcgagcgcaggcggtttttttaagtctgatgtga aagccctcggcttaaccgaggaagcgcatcggaaactgggaaacttgagtgcagaagaggacagtggaactccatgt gtagcggtgaaatgcgtagatatatggaagaacaccagtggcgaaggcggctgtctggtctgtaactgacgctgaggc tcgaaagcatgggtagcgaacaggattagataccctggtagtccatgccgtaaacgatgaatgctaggtgttggagggt ttccgcccttcagtgccgcagctaacgcattaagcattccgcctggggagtacgaccgcaaggttgaaactcaaagga attgacgggggcccgcacaagcggtggagcatgtggtttaattcgaagcaacgcgaagaaccttaccaggtcttgaca tcttttgatcacctgagagatcaggtttccccttcgggggcaaaatgacaggtggtgcatggttgtcgtcagctcgtgtcg tgagatgttgggttaagtcccgcaacgagcgcaacccttatgactagttgccagcatttagttgggcactctagtaagact gccggtgacaaaccggaggaaggtggggatgacgtcaaatcatcatgccccttatgacctgggctacacacgtgctac aatggatggtacaacgagttgcgagaccgcgaggtcaagctaatctcttaaagccattctcagttcggactgtaggctgc aactcgcctacacgaagtcggaatcgctagtaatcgcggatcagcacgccgcggtgaatacgttcccgggccttgtac acaccgcccgtcacaccatgagagtttgtaacacccgaagccggtggcgtaacccttttagggagcgagccgtctaag gtgggacaaatgattagggtgaagtcgtaacaaggtagccgtaggagaacctgcggctggatcacctcctt |
| *Lactobacillus_casei_ paracasei* | SEQ ID NO: 379 | tatgagagatgatcctggctcaggatgaacgctggcggcgtgcctaatacatgcaagtcgaacgagactcgttgatga tcggtgcttgcaccgagattcaacatggaacgagtggcggacgggtgagtaacacgtgggtaacctgcccttaagtgg gggataacataggaaacagatgctaataccgcatagatccaagaaccgcatggacttggctgaaagatggcgtaagc tatcgcttttggatggacccgcggcgtattagctagttggtgaggtaatggctcaccaaggcgatgatacgtagccgaac tgagaggttgatcggccacattgggactgagacacggcccaaactcctacgggaggcagcagtagggaatcttccac aatggacgcaagtctgatggagcaacgccgcgtgagtgaagaaggattcgggtcgtaaaactctgagttggagaag aatggtcggcagagtaactgagtcggcgtgacggtatccaaccagaaagccacggctaactacgtgccagcagccg cggtaatacgtaggtggcaagcgttatccggatttattgggcgtaaagcgagcgcaggcggtttttttaagtctgatgtga aagccctcggcttaaccgaggaagcgcatcggaaactgggaaacttgagtgcagaagaggacagtggaactccatgt gtagcggtgaaatgcgtagatatatggaagaacaccagtggcgaaggcggctgtctggtctgtaactgacgctgaggc tcgaaagcatgggtagcgaacaggattagataccctggtagtccatgccgtaaacgatgaatgctaggtgttggagggt ttccgcccttcagtgccgcagctaacgcattaagcattccgcctggggagtacgaccgcaaggttgaaactcaaagga attgacgggggcccgcacaagcggtggagcatgtggtttaattcgaagcaacgcgaagaaccttaccaggtcttgaca tcttttgatcacctgagagatcaggatccccttcgggggcaaaatgacaggtggtgcatggttgtcgtcagctcgtgtcg tgagatgagggttaagtcccgcaacgagcgcaacccttatgactagttgccagcatttagttgggcactctagtaagact gccggtgacaaaccggaggaaggtggggatgacgtcaaatcatcatgccccttatgacctgggctacacacgtgctac aatggatggtacaacgagttgcgagaccgcgaggtcaagctaatctcttaaagccattctcagttcggactgtaggctgc aactcgcctacacgaagtcggaatcgctagtaatcgcggatcagcacgccgcggtgaatacgttcccgggccttgtac acaccgcccgtcacaccatgagagtttgtaacacccgaagccggtggcgtaacccttttagggagcgagccgtctaag gtgggacaaatgattagggtgaagtcgtaacaaggtagccgtaggagaacctgcggctggatcacctcctt |
| *Enterococcus_faecium* | SEQ ID NO: 380 | tatgagagatgatcctggctcaggacgaacgctggcggcgtgcctaatacatgcaagtcgaacgctattctttcaccgg agcttgctccaccgaaagaaaaagagtggcgaacgggtgagtaacacgtgggtaacctgcccatcagaaggggata acacttggaaacaggtgctaataccgtataacactattttccgcatggaagaaagttgaaaggcgcttttgcgtcactgat |

TABLE 6-continued

| Full length 16S rDNA sequences of species (positive correlates) | | |
|---|---|---|
| Species Name | Sequence Identifier | 16S sequence |
| | | ggatggacccgcggtgcattagctagttggtgaggtaacggctcaccaaggcaacgatgcatagccgacctgagagg gtgatcggccacactgggactgagacacggcccagactcctacgggaggcagcagtagggaatcttcggcaatgga cgaaagtctgaccgagcaacgccgcgtgagtgaagaaggttttcggatcgtaaaactctgttgttagagaagaacaag gatgagagtagaacgttcatcccttgacggtatctaaccagaaagccacggctaactacgtgccagcagccgcggtaa tacgtaggtggcaagcgttgtccggatttattgggcgtaaagcgagcgcaggcggtttcttaagtctgatgtgaaagccc ccggctcaaccggggagggtcattggaaactgggagacttgagtgcagaagaggagagtggaattccatgtgtagcg gtgaaatgcgtagatatatggaggaacaccagtggcgaaggcggctctctggtctgtaactgacgctgaggctcgaaa gcgtggggagcgaacaggattagataccctggtagtccacgccgtaaacgatgagtgctaagtgttggagggtttccg cccttcagtgctgcagcaaacgcattaagcactccgcctggggagtacgaccgcaaggttgaaactcaaaggaattga cgggggcccgcacaagcggtggagcatgtggtttaattcgaagcaacgcgaagaaccttaccaggtcttgacatccat gaccactctagagatagagcttccccttcgggggcaaagtgacaggtggtgcatggagtcgtcagctcgtgtcgtgag atgttgggttaagtcccgcaacgagcgcaacccttattgttagttgccatcatttagttgggcactctagcgagactgccg gtgacaaaccggaggaaggtggggatgacgtcaaatcatcatgccccttatgacctgggctacacacgtgctacaatg ggaagtacaacgagttgcgaagtcgcgaggctaagctaatctcttaaagcttctctcagttcggattgtaggctgcaact cgcctacatgaagccggaatcgctagtaatcgcggatcagcacgccgcggtgaatacgttcccgggccttgtacacac cgcccgtcacaccacgagagtagtaacacccgaagtcggtgaggtaaccatttggagccagccgcctaaggtggga tagatgattggggtgaagtcgtaacaaggtagccgtatcggaaggtgcggctggatcacctccat |
| *Lactobacillus_casei_ paracasei* | SEQ ID NO: 381 | tatgagagatgatcctggctcaggatgaacgctggcggcgtgcctaatacatgcaagtcgaacgagactcgttgatga tcggtgcttgcaccgagattcaacatggaacgagtggcggacgggtgagtaacacgtgggtaacctgcccttaagtgg gggataacataggaaacagatgctaataccgcatagatccaagaaccgcatggacttggctgaaagatggcgtaagc tatcgcttttggatggacccgcggcgtattagctagttggtgaggtaatggctcaccaaggcgatgatacgtagccgaac tgagaggttgatcggccacattgggactgagacacggcccaaactcctacgggaggcagcagtagggaatcttccac aatggacgcaagtctgatggagcaacgccgcgtgagtgaagaaggattcgggtcgtaaaactctgagttggagaag aatggtcggcagagtaactgagtcggcgtgacggtatccaaccagaaagccacggctaactacgtgccagcagccg cggtaatacgtaggtggcaagcgttatccggatttattgggcgtaaagcgagcgcaggcggtttttttaagtctgatgtga aagccctcggcttaaccgaggaagcgcatcggaaactgggaaacttgagtgcagaagaggacagtggaactccatgt gtagcggtgaaatgcgtagatatatggaagaacaccagtggcgaaggcggctgtctggtctgtaactgacgctgaggc tcgaaagcatgggtagcgaacaggattagataccctggtagtccatgccgtaaacgatgaatgctaggtgttggagggt ttccgcccttcagtgccgcagctaacgcattaagcattccgcctggggagtacgaccgcaaggttgaaactcaaagga attgacgggggcccgcacaagcggtggagcatgtggtttaattcgaagcaacgcgaagaaccttaccaggtcttgaca tcttttgatcacctgagagatcaggatccccttcgggggcaaaatgacaggtggtgcatggttgtcgtcagctcgtgtcg tgagatgagggttaagtcccgcaacgagcgcaacccttatgactagttgccagcatttagagggcactctagtaagact gccggtgacaaaccggaggaaggtggggatgacgtcaaatcatcatgccccttatgacctgggctacacacgtgctac aatggatggtacaacgagttgcgagaccgcgaggtcaagctaatctcttaaagccattctcagttcggactgtaggctgc aactcgcctacacgaagtcggaatcgctagtaatcgcggatcagcacgccgcggtgaatacgttcccgggccttgtac acaccgcccgtcacaccatgagagtttgtaacacccgaagccggtggcgtaaccctttagggagcgagccgtctaag gtgggacaaatgattagggtgaagtcgtaacaaggtagccgtaggagaacctgcggctggatcacctcctt |
| *Lactobacillus_casei_ paracasei* | SEQ ID NO: 382 | tatgagagatgatcaggctcaggatgaacgctggcggcgtgcctaatacatgcaagtcgaacgagttctcgttgatga tcggtgcttgcaccgagattcaacatggaacgagtggcggacgggtgagtaacacgtgggtaacctgcccttaagtgg gggataacatttggaaacagatgctaataccgcatagatccaagaaccgcatggacttggctgaaagatggcgtaagc tatcgcttttggatggacccgcggcgtattagctagttggtgaggtaacggctcaccaaggcgatgatacgtagccgaa ctgagaggttgatcggccacattgggactgagacacggcccaaactcctacgggaggcagcagtagggaatcttcca caatggacgcaagtctgatggagcaacgccgcgtgagtgaagaaggctttcgggtcgtaaaactctgagttggagaa gaatggtcggcagagtaactgttgtcggcgtgacggtatccaaccagaaagccacggctaactacgtgccagcagcc gcggtaatacgtaggtggcaagcgttatccggatttattgggcgtaaagcgagcgcaggcggtttttttaagtctgatgtg aaagccctcggcttaaccgaggaagcgcatcggaaactgggaaacttgagtgcagaagaggacagtggaactccat |

TABLE 6-continued

Full length 16S rDNA sequences of species (positive correlates)

| Species Name | Sequence Identifier | 16S sequence |
|---|---|---|
| | | gtgtagcggtgaaatgcgtagatatatggaagaacaccagtggcgaaggcggctgtctggtctgtaactgacgctgag<br>gctcgaaagcatgggtagcgaacaggattagataccctggtagtccatgccgtaaacgatgaatgctaggtgttggag<br>ggtttccgcccttcagtgccgcagctaacgcattaagcattccgcctggggagtacgaccgcaaggttgaaactcaaag<br>gaattgacgggggcccgcacaagcggtggagcatgtggtttaattcgaagcaacgcgaagaaccttaccaggtcttga<br>catcttttgatcacctgagagatcaggtttccccttcgggggcaaaatgacaggtggtgcatggttgtcgtcagctcgtgt<br>cgtgagatgagggttaagtcccgcaacgagcgcaacccttatgactagagccagcatttagttgggcactctagtaag<br>actgccggtgacaaaccggaggaaggtggggatgacgtcaaatcatcatgccccttatgacctgggctacacacgtgc<br>tacaatggatggtacaacgagttgcgagaccgcgaggttaagctaatctcttaaagccattctcagttcggactgtaggc<br>tgcaactcgcctacacgaagtcggaatcgctagtaatcgcggatcagcacgccgcggtgaatacgttcccgggccttg<br>tacacaccgcccgtcacaccatgagagtagtaacacccgaagccggtggcgtaacccattagggagcgagccgtct<br>aaggtgggacaaatgattagggtgaagtcgtaacaaggtagccgtaggagaacctgcggctggatcacctcctt |
| *Lactobacillus_casei_ paracasei* | SEQ ID NO: 383 | tatgagagatgatcctggctcaggatgaacgctggcggcgtgcctaatacatgcaagtcgaacgagttctcgttgatga<br>tcggtgcttgcactgagattcaacatggaacgagtggcggacgggtgagtaacacgtgggtaacctgcccttaagtgg<br>gggataacataggaaacagatgctaataccgcatagatccaagaaccgcatggacttggctgaaagatggcgtaagc<br>tatcgcttttggatggacccgcggcgtattagctagttggtgaggtaatggctcaccaaggcgatgatacgtagccgaac<br>tgagaggttgatcggccacattgggactgagacacggcccaaactcctacgggaggcagcagtagggaatcttccac<br>aatggacgcaagtctgatggagcaacgccgcgtgagtgaagaaggctttcgggtcgtaaaactctgttgttggagaag<br>aatggtcggcagagtaactgttgtcggcgtgacggtatccaaccagaaagccacggctaactacgtgccagcagccg<br>cggtaatacgtaggtggcaagcgttatccggatttattgggcgtaaagcgagcgcaggcggtttttttaagtctgatgtga<br>aagccctcggcttaaccgaggaagcgcatcggaaactgggaaacttgagtgcagaagaggacagtggaactccatgt<br>gtagcggtgaaatgcgtagatatatggaagaacaccagtggcgaaggcggctgtctggtctgtaactgacgctgaggc<br>tcgaaagcatgggtagcgaacaggattagataccctggtagtccatgccgtaaacgatgaatgctaggtgttggagggt<br>ttccgcccttcagtgccgcagctaacgcattaagcattccgcctggggagtacgaccgcaaggttgaaactcaaagga<br>attgacgggggcccgcacaagcggtggagcatgtggtttaattcgaagcaacgcgaagaaccttaccaggtcttgaca<br>tcttttgatcacctgagagatcaggtaccccttcgggggcaaaatgacaggtggtgcatggttgtcgtcagctcgtgtcg<br>tgagatgagggttaagtcccgcaacgagcgcaacccttatgactagttgccagcatttagttgggcactctagtaagact<br>gccggtgacaaaccggaggaaggtggggatgacgtcaaatcatcatgccccttatgacctgggctacacacgtgctac<br>aatggatggtacaacgagttgcgagaccgcgaggtcaagctaatctcttaaagccattctcagttcggactgtaggctgc<br>aactcgcctacacgaagtcggaatcgctagtaatcgcggatcagcacgccgcggtgaatacgttcccgggccttgtac<br>acaccgcccgtcacaccatgagagtttgtaacacccgaagccggtggcgtaacccttttagggagcgagccgtctaag<br>gtgggacaaatgattagggtgaagtcgtaacaaggtagccgtaggagaacctgcggctggatcacctcctt |
| *Lactobacillus_casei_ paracasei* | SEQ ID NO: 384 | tatgagagatgatcctggctcaggatgaacgctggcggcgtgcctaatacatgcaagtcgaacgagttctcgttgatga<br>tcggtgcttgcaccgagattcaacatggaacgagtggcggacgggtgagtaacacgtgggtaacctgcccttaagtgg<br>gggataacatttggaaacagatgctaataccgcatagatccaagaaccgcatggttcaggctgaaagatggcgtaagc<br>tatcgcttttggatggacccgcggcgtattagctagttggtgaggtaatggctcaccaaggcgatgatacgtagccgaac<br>tgagaggttgatcggccacattgggactgagacacggcccaaactcctacgggaggcagcagtagggaatcttccac<br>aatggacgcaagtctgatggagcaacgccgcgtgagtgaagaaggctttcgggtcgtaaaactctgagttggagaag<br>aatggtcggcagagtaactgttgtcggcgtgacggtatccaaccagaaagccacggctaactacgtgccagcagccg<br>cggtaatacgtaggtggcaagcgttatccggatttattgggcgtaaagcgagcgcaggcggtttttttaagtctgatgtga<br>aagccctcggcttaaccgaggaagcgcatcggaaactgggaaacttgagtgcagaagaggacagtggaactccatgt<br>gtagcggtgaaatgcgtagatatatggaagaacaccagtggcgaaggcggctgtctggtctgtaactgacgctgaggc<br>tcgaaagcatgggtagcgaacaggattagataccctggtagtccatgccgtaaacgatgaatgctaggtgttggagggt<br>ttccgcccttcagtgccgcagctaacgcattaagcattccgcctggggagtacgaccgcaaggttgaaactcaaagga<br>attgacgggggcccgcacaagcggtggagcatgtggtttaattcgaagcaacgcgaagaaccttaccaggtcttgaca<br>tcttttgatcacctgagagatcaggtttccccttcgggggcaaaatgacaggtggtgcatggttgtcgtcagctcgtgtcg<br>tgagatgttgggttaagtcccgcaacgagcgcaacccttatgactagttgccagcatttagttgggcactctagtaagact |

TABLE 6-continued

Full length 16S rDNA sequences of species (positive correlates)

| Species Name | Sequence Identifier | 16S sequence |
|---|---|---|
| | | gccggtgacaaaccggaggaaggtggggatgacgtcaaatcatcatgccccttatgacctgggctacacacgtgctac aatggatggtacaacgagttgcgagaccgcgaggtcaagctaatctcttaaagccattctcagttcggactgtaggctgc aactcgcctacacgaagtcggaatcgctagtaatcgcggatcagcacgccgcggtgaatacgttcccgggccttgtac acaccgcccgtcacaccatgagagtttgtaacacccgaagccggtggcgtaacccttttagggagcgagccgtctaag gtgggacaaatgattagggtgaagtcgtaacaaggtagccgtaggagaacctgcggctggatcacctcctt |
| *Lactobacillus_casei_ paracasei* | SEQ ID NO: 385 | tatgagagtttgatcaggctcaggatgaacgctggcggcgtgcctaatacatgcaagtcgaacgagttctcgttgatga tcggtgcttgcaccgagattcaacatagaacgagtggcggacgggtgagtaacacgtgggtaacctgcccttaagtgg gggataacatttggaaacagatgctaataccgcatagatccaagaaccgcatggacctggctgaaagatggcgtaagc tatcgcttttggatggacccgcggcgtattagctagttggtgaggtaatggctcaccaaggcgatgatacgtagccgaac tgagaggttgatcggccacattgggactgagacacggcccaaactcctacgggaggcagcagtagggaatcttccac aatggacgcaagtctgatggagcaacgccgcgtgagtgaagaaggctttcgggtcgtaaaactctgagttggagaag aatggtcggcagagtaactgttgtcggcgtgacggtatccaaccagaaagccacggctaactacgtgccagcagccg cggtaatacgtaggtggcaagcgttatccggatttattgggcgtaaagcgagcgcaggcggtttttttaagtctgatgtga aagccctcggcttaaccgaggaagcgcatcggaaactgggaaacttgagtgcagaagaggacagtggaactccatgt gtagcggtgaaatgcgtagatatatggaagaacaccagtggcgaaggcggctgtctggtctgtaactgacgctgaggc tcgaaagcatgggtagcgaacaggattagataccctggtagtccatgccgtaaacgatgaatgctaggtgttggagggt ttccgccatcagtgccgcagctaacgcattaagcattccgcctggggagtacgaccgcaaggttgaaactcaaagga attgacgggggcccgcacaagcggtggagcatgtggtttaattcgaagcaacgcgaagaaccttaccaggtcttgaca tcttttgatcacctgagagatcaggtttccccttcgggggcaaaatgacaggtggtgcatggttgtcgtcagctcgtgtcg tgagatgttgggttaagtcccgcaacgagcgcaacccttatgactagttgccagcatttagttgggcactctagtaagact gccggtgacaaaccggaggaaggtggggatgacgtcaaatcatcatgccccttatgacctgggctacacacgtgctac aatggatggtacaacgagttgcgagaccgcgaggtcaagctaatctcttaaagccattctcagttcggactgtaggctgc aactcgcctacacgaagtcggaatcgctagtaatcgcggatcagcacgccgcggtgaatacgttcccgggccttgtac acaccgcccgtcacaccatgagagtttgtaacacccgaagccggtggcgtaacccttttagggagcgagccgtctaag gtgggacaaatgattagggtgaagtcgtaacaaggtagccgtaggagaacctgcggctggatcacctcatt |
| *Lactobacillus_ plantarum* | SEQ ID NO: 386 | tttgagagtttgatcctggctcaggacgaacgctggcggcgtgcctaatacatgcaagtcgaacgaactctggtattgatt ggtgcttgcatcatgatttacatttgagtgagtggcgaactggtgagtaacacgtgggaaacctgcccagaagcgggg gataacacctggaaacagatgctaataccgcataacaacttggaccgcatggtccgagtttgaaagatggcttcggctat cacttctggatggtcccgcggcgtattagctagatggtggggtaacggctcaccatggcaatgatacgtagccgacctg agagggtaatcggccacattgggactgagacacggcccaaactcctacgggaggcagcagtagggaatcttccaca atggacgaaagtctgatggagcaacgccgcgtgagtgaagaagggtttcggctcgtaaaactctgttgttaaagaaga acatatctgagagtaactgttcaggtattgacggtatttaaccagaaagccacggctaactacgtgccagcagccgcgg taatacgtaggtggcaagcgttgtccggatttattgggcgtaaagcgagcgcaggcggttttttaagtctgatgtgaaag ccttcggctcaaccgaagaagtgcatcggaaactgggaaacttgagtgcagaagaggacagtggaactccatgtgta gcggtgaaatgcgtagatatatggaagaacaccagtggcgaaggcggctgtctggtctgtaactgacgctgaggctcg aaagtatgggtagcaaacaggattagataccctggtagtccataccgtaaacgatgaatgctaagtgttggagggtttcc gcccttcagtgctgcagctaacgcattaagcattccgcctggggagtacggccgcaaggctgaaactcaaaggaattg acgggggcccgcacaagcggtggagcatgtggataattcgaagctacgcgaagaaccttaccaggtcttgacatact atgcaaatctaagagattagacgacccttcggggacatggatacaggtggtgcatggagtcgtcagctcgtgtcgtga gatgttgggttaagtcccgcaacgagcgcaacccttattatcagttgccagcattaagttgggcactctggtgagactgc cggtgacaaaccggaggaaggtggggatgacgtcaaatcatcatgccccttatgacctgggctacacacgtgctacaa tggatggtacaacgagttgcgaactcgcgagagcaagctaatctcttaaagccattctcagttcggattgtaggctgcaa ctcgcctacatgaagtcggaatcgctagtaatcgcggatcagcatgccgcggtgaatacgttcccgggccttgtacaca ccgcccgtcacaccatgagagtttgtaacacccaaagtcggtggggtaaccttttaggaaccagccgcctaaggtggg acagatgattagggtgaagtcgtaacaaggtagccgtaggagaacctgcggctggatcacctcctt |

TABLE 6-continued

Full length 16S rDNA sequences of species (positive correlates)

| Species Name | Sequence Identifier | 16S sequence |
|---|---|---|
| *Enterobacter_cloacae* | SEQ ID NO: 387 | agcggcggacgggtgagtaatgtctgggaaactgcctgatggagggggataactactggaaacggtagctaataccg cataacgtcgcaagaccaaagagggggaccttcgggcctcttgccatcagatgtgcccagatgggattagctagtagg tggggtaacggctcacctaggcgacgatccctagctggtctgagaggatgaccagccacactggaactgagacacgg tccagactcctacgggaggcagcagtggggaatattgcacaatgggcgcaagcctgatgcagccatgccgcgtgtat gaagaaggccttcgggttgtaaagtactttcagcggggaggaaggcgttgaggttaataacctcagcgattgacgttac ccgcagaagaagcaccggctaactccgtgccagcagccgcggtaatacggagggtgcaagcgttaatcggaattact gggcgtaaagcgcacgcaggcggtctgtcaagtcggatgtgaaatccccgggctcaacctgggaactgcattcgaaa ctggcaggctagagtcttgtagaggggggtagaattccaggtgtagcggtgaaatgcgtagagatctggaggaatacc ggtggcgaaggcggcccccctggacaaagactgacgctcaggtgcgaaagcgtggggagcaaacaggattagatac cctggtagtccacgccgtaaacgatgtcgacttggaggagtgcccttgaggcgtggcaccggagctaacgcgttaag tcgaccgcctggggagtacggccgcaaggttaaaactcaaatgaattgacgggggcccgcacaagcggtggagcat gtggtttaattcgatgcaacgcgaagaaccttacctactcttgacatccagagaactaccagagatggattggtgccttc gggaactctgagacaggtgctgcatggctgtcgtcagctcgtgagtgaaatgttgggttaagtcccgcaacgagcgca acccttatcctttgttgccagcggttcggccgggaactcaaaggagactgccagtgataaactggaggaaggtgggga tgacgtcaagtcatcatggcccttacgagtagggctacacacgtgctacaatggcgcatacaaagagaagcgacctcg cgagagcaagcggacctcataaagtgcgtcgtagtccggattggagtctgcaactcgactccatgaagtcggaatcgc tagtaatcgtagatcagaatgctacggtgaatacgttcccgggccttgtacacaccgcccgtcacaccatgggagtggg ttgcaaaagaagtaggtagcttaaccttcgggagggcgcttaccactttgtgattcatgactggggtgaagtcgtaacaa ggtaaccgtaggggaacctgcggttggatcacctcctt |
| *Escherichia_coli* | SEQ ID NO: 388 | ttgaagagtttgatcatggctcagattgaacgctggcggcaggcctaacacatgcaagtcgaacggtaacaggaatca gcttgctgattcgctgacgagtggcggacgggtgagtaatgtctgggaaactgcctgatggagggggataactactgg aaacggtagctaataccgcataacgtcgcaagaccaaagagggggaccttcgggcctcttgccatcggatgtgccca gatgggattagctagtaggtggggtaaaggctcacctaggcgacgatccctagctggtctgagaggatgaccagcca cactggaactgagacacggtccagactcctacgggaggcagcagtggggaatattgcacaatgggcgcaagcctgat gcagccatgccgcgtgtatgaagaaggccttcgggagtaaagtactttcagcggggaggaagggagtaaagttaata cctttgctcattgacgttacccgcagaagaagcaccggctaactccgtgccagcagccgcggtaatacggagggtgca agcgttaatcggaattactgggcgtaaagcgcacgcaggcggtttgttaagtcagatgtgaaatccccgggctcaacct gggaactgcatctgatactggcaagcttgagtctcgtagaggggggtagaattccaggtgtagcggtgaaatgcgtag agatctggaggaataccggtggcgaaggcggccccctggacgaagactgacgctcaggtgcgaaagcgtggggag caaacaggattagataccctggtagtccacgccgtaaacgatgtcgacttggaggttgtgcccttgaggcgtggcttcc ggagctaacgcgttaagtcgaccgcctggggagtacggccgcaaggttaaaactcaaatgaattgacgggggcccg cacaagcggtggagcatgtggtttaattcgatgcaacgcgaagaaccttacctggtcttgacatccacagaaccagtag agatacgagggtgccttcgggaactgtgagacaggtgctgcatggctgtcgtcagctcgtgttgtgaaatgttgggttaa gtcccgcaacgagcgcaacccttatcctttgttgccagcggtccggccgggaactcaaaggagactgccagtgataaa ctggaggaaggtggggatgacgtcaagtcatcatggcccttacgaccagggctacacacgtgctacaatggcgcata caaagagaagcgacctcgcgagagcaagcggacctcataaagtgcgtcgtagtccggattggagtctgcaactcgac tccatgaagtcggaatcgctagtaatcgtggatcagaatgccacggtgaatacgttcccgggccttgtacacaccgccc gtcacaccatgggagtgggttgcaaaagaagtaggtagcttaaccttcgggagggcgcttaccactttgtgattcatgac tggggtgaagtcgtaacaaggtaaccgtaggggaacctgcggttggatcacctcctt |
| *Escherichia_coli* | SEQ ID NO: 389 | ttgaagagtttgatcatggctcagattgaacgctggcggcaggcctaacacatgcaagtcgaacggtaacaggaagaa gcttgcttcatgctgacgagtggcggacgggtgagtaatgtctgggaaactgcctgatggagggggataactactgga aacggtagctaataccgcataacgtcgcaagaccaaagagggggaccacgggcctcttgccatcggatgtgcccag atgggattagctagtaggtggggtaaaggctcacctaggcgacgatccctagctggtctgagaggatgaccagccaca ctggaactgagacacggtccagactcctacgggaggcagcagtggggaatattgcacaatgggcgcaagcctgatg cagccatgccgcgtgtatgaagaaggccttcgggttgtaaagtactttcagcggggaggaagggagtaaagttaatac ctttgctcattgacgttacccgcagaagaagcaccggctaactccgtgccagcagccgcggtaatacggagggtgcaa |

TABLE 6-continued

Full length 16S rDNA sequences of species (positive correlates)

| Species Name | Sequence Identifier | 16S sequence |
|---|---|---|
| | | gcgttaatcggaattactgggcgtaaagcgcacgcaggcggtttgttaagtcagatgtgaaatccccgggctcaacctg<br>ggaactgcatctgatactggcaagcttgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc<br>ccgcaacgagcgcaacccttatcctagttgccagcggtccggccgggaactcaaaggagactgccagtgataaactg<br>gaggaaggtggggatgacgtcaagtcatcatggccatacgaccagggctacacacgtgctacaatggcgcatacaa<br>agagaagcgacctcgcgagagcaagcggacctcataaagtgcgtcgtagtccggattggagtctgcaactcgactcc<br>atgaagtcggaatcgctagtaatcgtggatcagaatgccacggtgaatacgacccgggccagtacacaccgcccgtc<br>acaccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Escherichia_coli* | SEQ ID NO: 390 | ttgaagagtttgatcatggctcagattgaacgctggcggcaggcctaacacatgcaagtcgaacggtaacaggaagaa<br>gcttgcttcatgctgacgagtggcggacgggtgagtaatgtagggaaactgcctgatggagggggataactactgga<br>aacggtagctaataccgcataacgtcgcaagaccaaagagggggaccttcgggcctcttgccatcggatgtgcccag<br>atgggattagctagtaggtggggtaaaggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggagtaaagtactttcagcggggaggaagggagtaaagttaatac<br>ctttgctcattgacgttacccgcagaagaagcaccggctaactccgtgccagcagccgcggtaatacggagggtgcaa<br>gcgttaatcggaattactgggcgtaaagcgcacgcaggcggtttgttaagtcagatgtgaaatccccgggctcaacctg<br>ggaactgcatctgatactggcaagcttgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc<br>ccgcaacgagcgcaacccttatcctagttgccagcggtccggccgggaactcaaaggagactgccagtgataaactg<br>gaggaaggtggggatgacgtcaagtcatcatggcccttacgaccagggctacacacgtgctacaatggcgcatacaa<br>agagaagcgacctcgcgagagcaagcggacctcataaagtgcgtcgtagtccggattggagtctgcaactcgactcc<br>atgaagtcggaatcgctagtaatcgtggatcagaatgccacggtgaatacgacccgggccagtacacaccgcccgtc<br>acaccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Escherichia_coli* | SEQ ID NO: 391 | ttgaagagtttgatcatggctcagattgaacgctggcggcaggcctaacacatgcaagtcgaacggtaacaggaagaa<br>gcttgcttcatgctgacgagtggcggacgggtgagtaatgtagggaaactgcctgatggagggggataactactgga<br>aacggtagctaataccgcataacgtcgcaagaccaaagagggggaccttcgggcctcttgccatcggatgtgcccag<br>atgggattagctagtaggtggggtaaaggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggttgtaaagtactttcagcggggaggaagggagtaaagttaatac<br>ctttgctcattgacgttacccgcagaagaagcaccggctaactccgtgccagcagccgcggtaatacggagggtgcaa<br>gcgttaatcggaattactgggcgtaaagcgcacgcaggcggtttgttaagtcagatgtgaaatccccgggctcaacctg<br>ggaactgcatctgatactggcaagcttgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggataattcgatgcaacgcgaagaaccttacctggtcttgacatccacagaactaccagag |

TABLE 6-continued

Full length 16S rDNA sequences of species (positive correlates)

| Species Name | Sequence Identifier | 16S sequence |
|---|---|---|
| | | atggattggtgccttcgggaactgtgagacaggtgctgcatggctgtcgtcagctcgtgttgtgaaatgagggttaagtc<br>ccgcaacgagcgcaacccttatcctagttgccagcggtccggccgggaactcaaaggagactgccagtgataaactg<br>gaggaaggtggggatgacgtcaagtcatcatggccatacgaccagggctacacacgtgctacaatggcgcatacaa<br>agagaagcgacctcgcgagagcaagcggacctcataaagtgcgtcgtagtccggattggagtctgcaactcgactcc<br>aatgaagtcggaatcgctagtaatcgtggatcagaatgccacggtgatacgttcccgggccttgtacacaccgcccgtc<br>acaccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Escherichia_coli* | SEQ ID NO: 392 | ttgaagagtttgatcatggctcagattgaacgctggcggcaggcctaacacatgcaagtcgaacggtaacaggaagaa<br>gcttgcttctttgctgacgagtggcggacgggtgagtaatgtctgggaaactgcctgatggagggggataactactgga<br>aacggtagctaataccgcataacgtcgcaagaccaaagagggggaccttcgggcctcttgccatcggatgtgcccag<br>atgggattagctagtaggtggggtaaaggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggttgtaaagtactttcagcggggaggaagggagtaaagttaatac<br>ctttgctcattgacgttacccgcagaagaagcaccggctaactccgtgccagcagccgcggtaatacggagggtgcaa<br>gcgttaatcggaattactgggcgtaaagcgcacgcaggcggtttgttaagtcagatgtgaaatccccgggctcaacctg<br>ggaactgcatctgatactggcaagatgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc<br>ccgcaacgagcgcaacccttatcctttgagccagcggtccggccgggaactcaaaggagactgccagtgataaactg<br>gaggaaggtggggatgacgtcaagtcatcatggcccttacgaccagggctacacacgtgctacaatggcgcatacaa<br>agagaagcgacctcgcgagagcaagcggacctcataaagtgcgtcgtagtccggattggagtctgcaactcgactcc<br>atgaagtcggaatcgctagtaatcgtggatcagaatgccacggtgaatacgacccgggccagtacacaccgcccgtc<br>acaccatgggagtgggagcaaaagaagtaggtagcttaaccacgggagggcgcttaccactagtgattcatgactgg<br>ggtgaagtcgtaacaaggtaaccgtaggggaacctgcggttggatcacctcctt |
| *Escherichia_coli* | SEQ ID NO: 393 | ttgaagagtttgatcatggctcagattgaacgctggcggcaggcctaacacatgcaagtcgaacggtaacaggaagaa<br>gcttgcactttgctgacgagtggcggacgggtgagtaatgtagggaaactgcctgatggagggggataactactgga<br>aacggtagctaataccgcataacgtcgcaagaccaaagagggggaccttcgggcctatgccatcggatgtgcccag<br>atgggattagctagtaggtggggtaaaggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggttgtaaagtactttcagcggggaggaagggagtaaagttaatac<br>ctttgctcattgacgttacccgcagaagaagcaccggctaactccgtgccagcagccgcggtaatacggagggtgcaa<br>gcgttaatcggaattactgggcgtaaagcgcacgcaggcggtttgttaagtcagatgtgaaatccccgggctcaacctg<br>ggaactgcatctgatactggcaagcttgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctggtcttgacatccacagaaccttgtagag<br>atacgagggtgccacgggaactgtgagacaggtgctgcatggctgtcgtcagctcgtgttgtgaaatgttgggttaagt<br>cccgcaacgagcgcaacccttatcctagttgccagcggtccggccgggaactcaaaggagactgccagtgataaact<br>ggaggaaggtggggatgacgtcaagtcatcatggcccttacgaccagggctacacacgtgctacaatggcgcataca<br>aagagaagcgacctcgcgagagcaagcggacctcataaagtgcgtcgtagtccggattggagtctgcaactcgactc<br>catgaagtcggaatcgctagtaatcgtggatcagaatgccacggtgaatacgacccgggccagtacacaccgcccgt |

TABLE 6-continued

Full length 16S rDNA sequences of species (positive correlates)

| Species Name | Sequence Identifier | 16S sequence |
| --- | --- | --- |
| | | cacaccatgggagtgggttgcaaaagaagtaggtagcttaaccttcgggagggcgataccactagtgattcatgactg<br>gggtgaagtcgtaacaaggtaaccgtaggggaacctgcggttggatcacctcctt |
| *Escherichia_coli* | SEQ ID NO: 394 | ttgaagagtttgatcatggctcagattgaacgctggcggcaggcctaacacatgcaagtcgaacggtaacaggaagaa<br>gcttgcttctttgctgacgagtggcggacgggtgagtaatgtctgggaaactgcctgatggagggggataactactgga<br>aacggtagctaataccgcataacgtcgcaagaccaaagagggggaccttcgggcctcttgccatcggatgtgcccag<br>atgggattagctagtaggtggggtaaaggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtatgaagaaggccttcgggttgtaaagtactttcagcggggaggaagggagtaaagttaatac<br>ctttgctcattgacgttacccgcagaagaagcaccggctaactccgtgccagcagccgcggtaatacggagggtgcaa<br>gcgttaatcggaattactgggcgtaaagcgcacgcaggcggtagttaagtcagatgtgaaatccccgggctcaacctg<br>ggaactgcatctgatactggcaagcttgagtctcgtagaggggggtagaattccaggtgtagcggtgaaatgcgtaga<br>gatctggaggaataccggtggcgaaggcggccccctggacgaagactgacgctcaggtgcgaaagcgtggggagc<br>aaacaggattagataccctggtagtccacgccgtaaacgatgtcgacttggaggttgtgcccttgaggcgtggcttccg<br>gagctaacgcgttaagtcgaccgcctggggagtacggccgcaaggttaaaactcaaatgaattgacgggggcccgca<br>caagcggtggagcatgtggtttaattcgatgcaacgcgaagaaccttacctggtcttgacatccacagaaccttgtagag<br>atacgagggtgccttcgggaactgtgagacaggtgctgcatggctgtcgtcagctcgtgttgtgaaatgttgggttaagt<br>cccgcaacgagcgcaacccttatcctagttgccagcggtccggccgggaactcaaaggagactgccagtgataaact<br>ggaggaaggtggggatgacgtcaagtcatcatggccatacgaccagggctacacacgtgctacaatggcgcataca<br>aagagaagcgacctcgcgagagcaagcggacctcataaagtgcgtcgtagtccggattggagtctgcaactcgactc<br>catgaagtcggaatcgctagtaatcgtggatcagaatgccacggtgaatacgacccgggccagtacacaccgcccgt<br>cacaccatgggagtgggttgcaaaagaagtaggtagcttaaccttcgggagggcgcttaccactagtgattcatgactg<br>gggtgaagtcgtaacaaggtaaccgtaggggaacctgcggttggatcacctcctt |
| *Klebsiella_pneumoniae* | SEQ ID NO: 395 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataacgtcgcaagaccaaagtgggggaccttcgggcctcatgccatcagatgtgcccag<br>atgggattagctagtaggtggggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtgtgaagaaggccttcgggttgtaaagcactttcagcggggaggaaggcggtgaggttaataa<br>cctcatcgattgacgttacccgcagaagaagcaccggctaactccgtgccagcagccgcggtaatacggagggtgca<br>agcgttaatcggaattactgggcgtaaagcgcacgcaggcggtctgtcaagtcggatgtgaaatccccgggcttaacct<br>gggaactgcattcgaaactggcaggctagagtcttgtagaggggggtagaattccaggtgtagcggtgaaatgcgtag<br>agatctggaggaataccggtggcgaaggcggccccctggacaaagactgacgctcaggtgcgaaagcgtggggag<br>caaacaggattagataccctggtagtccacgccgtaaacgatgtcgataggaggttgtgcccttgaggcgtggatccg<br>gagctaacgcgttaaatcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc<br>ccgcaacgagcgcaacccttatcctagttgccagcggtccggccgggaactcaaaggagactgccagtgataaactg<br>gaggaaggtggggatgacgtcaagtcatcatggccatacgaccagggctacacacgtgctacaatggcatatacaaa<br>gagaagcgacctcgcgagagcaagcggacctcataaagtatgtcgtagtccggattggagtctgcaactcgactccat<br>gaagtcggaatcgctagtaatcgtagatcagaatgctacggtgaatacgttcccgggccttgtacacaccgcccgtcac<br>accatgggagtgggagcaaaagaagtaggtagcttaaccttcgggagggcgcttaccactagtgattcatgactggg<br>gtgaagtcgtaacaaggtaaccgtaggggaacctgcggttggatcacctcctt |
| *Klebsiella_pneumoniae* | SEQ ID NO: 396 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataacgtcgcaagaccaaagtgggggaccttcgggcctcatgccatcagatgtgcccag |

TABLE 6-continued

Full length 16S rDNA sequences of species (positive correlates)

| Species Name | Sequence Identifier | 16S sequence |
|---|---|---|
| | | atgggattagctagtaggtggggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtgtgaagaaggccttcgggagtaaagcactacagcggggaggaaggcgttaaggttaataa<br>ccttggcgattgacgttacccgcagaagaagcaccggctaactccgtgccagcagccgcggtaatacggagggtgca<br>agcgttaatcggaattactgggcgtaaagcgcacgcaggcggtctgtcaagtcggatgtgaaatccccgggctcaacc<br>tgggaactgcattcgaaactggcaggctagagtcttgtagaggggggtagaattccaggtgtagcggtgaaatgcgta<br>gagatctggaggaataccggtggcgaaggcggcccccctggacaaagactgacgctcaggtgcgaaagcgtgggga<br>gcaaacaggattagataccctggtagtccacgccgtaaacgatgtcgatttggaggttgtgcccttgaggcgtggatcc<br>ggagctaacgcgttaaatcgaccgcctggggagtacggccgcaaggttaaaactcaaatgaattgacgggggcccgc<br>acaagcggtggagcatgtggtttaattcgatgcaacgcgaagaaccttacctggtcttgacatccacagaactttccaga<br>gatggattggtgccttcgggaactgtgagacaggtgctgcatggctgtcgtcagctcgtgttgtgaaatgttgggttaagt<br>cccgcaacgagcgcaacccttatcctagttgccagcggtccggccgggaactcaaaggagactgccagtgataaact<br>ggaggaaggtggggatgacgtcaagtcatcatggccatacgaccagggctacacacgtgctacaatggcatatacaa<br>agagaagcgacctcgcgagagcaagcggacctcataaagtatgtcgtagtccggattggagtctgcaactcgactcca<br>tgaagtcggaatcgctagtaatcgtagatcagaatgctacggtgaatacgttcccgggccttgtacacaccgcccgtca<br>caccatgggagtgggagcaaaagaagtaggtagcttaaccacgggagggcgcttaccactagtgattcatgactgg<br>ggtgaagtcgtaacaaggtaaccgtaggggaacctgcggttggatcacctcctt |
| *Klebsiella_pneumoniae* | SEQ ID NO: 397 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataatgtcgcaagaccaaagtgggggaccttcgggcctcatgccatcagatgtgcccaga<br>tgggattagctagtaggtggggtaacggctcacctaggcgacgatccctagctggtctgagaggatgaccagccacac<br>tggaactgagacacggtccagactcctacgggaggcagcagtggggaatattgcacaatgggcgcaagcctgatgc<br>agccatgccgcgtgtgtgaagaaggccttcgggttgtaaagcactttcagcggggaggaaggcggtgaggttaataac<br>ctcatcgattgacgttacccgcagaagaagcaccggctaactccgtgccagcagccgcggtaatacggagggtgcaa<br>gcgttaatcggaattactgggcgtaaagcgcacgcaggcggtctgtcaagtcggatgtgaaatccccgggctcaacct<br>gggaactgcattcgaaactggcaggctagagtcttgtagaggggggtagaattccaggtgtagcggtgaaatgcgtag<br>agatctggaggaataccggtggcgaaggcggcccccctggacaaagactgacgctcaggtgcgaaagcgtggggag<br>caaacaggattagataccctggtagtccacgccgtaaacgatgtcgataggaggttgtgcccttgaggcgtggatccg<br>gagctaacgcgttaaatcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc<br>ccgcaacgagcgcaacccttatcctagttgccagcggtccggccgggaactcaaaggagactgccagtgataaactg<br>gaggaaggtggggatgacgtcaagtcatcatggcccttacgaccagggctacacacgtgctacaatggcatatacaaa<br>gagaagcgacctcgcgagagcaagcggacctcataaagtatgtcgtagtccggattggagtctgcaactcgactccat<br>gaagtcggaatcgctagtaatcgtagatcagaatgctacggtgaatacgttcccgggccttgtacacaccgcccgtcac<br>accatgggagtgggagcaaaagaagtaggtagcttaaccttcgggagggcgcttaccactagtgattcatgactggg<br>gtgaagtcgtaacaaggtaaccgtaggggaacctgcggaggatcacctcctt |
| *Klebsiella_pneumoniae* | SEQ ID NO: 398 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataacgtcgcaagaccaaagtgggggaccttcgggcctcatgccatcagatgtgcccag<br>atgggattagctagtaggtggggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtgtgaagaaggccttcgggagtaaagcactacattggggaggaaggcgttaaggttaataa<br>ccttggcgattgacgttacccgcagaagaagcaccggctaactccgtgccagcagccgcggtaatacggagggtgca<br>agcgttaatcggaattactgggcgtaaagcgcacgcaggcggtctgtcaagtcggatgtgaaatccccgggctcaacc<br>tgggaactgcattcgaaactggcaggctagagtcttgtagaggggggtagaattccaggtgtagcggtgaaatgcgta |

TABLE 6-continued

Full length 16S rDNA sequences of species (positive correlates)

| Species Name | Sequence Identifier | 16S sequence |
|---|---|---|
| | | gagatctggaggaataccggtggcgaaggcggcccctggacaaagactgacgctcaggtgcgaaagcgtgggga<br>gcaaacaggattagataccctggtagtccacgccgtaaacgatgtcgatttggaggttgtgcccttgaggcgtggcttcc<br>ggagctaacgcgttaaatcgaccgcctggggagtacggccgcaaggttaaaactcaaatgaattgacgggggcccgc<br>acaagcggtggagcatgtggtttaattcgatgcaacgcgaagaaccttacctggtcttgacatccacagaactttccaga<br>gatggattggtgctttcgggaactgtgagacaggtgctgcatggctgtcgtcagctcgtgagtgaaatgttgggttaagt<br>cccgcaacgagcgcaacccttatcctttgttgccagcggttcggccgggaactcaaaggagactgccagtgataaact<br>ggaggaaggtggggatgacgtcaagtcatcatggcccttacgaccagggctacacacgtgctacaatggcatatacaa<br>agagaagcgacctttgcgagagcaagcggacctcataaagtatgtcgtagtttcggattggagtctgcaactcgactcca<br>tgaagtcggaatcgctagtaatcgtagatcagaatgctacggtgaatacgttcccgggccttgtacacaccgcccgtca<br>caccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Klebsiella_pneumoniae* | SEQ ID NO: 399 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataatgtcgcaagaccaaagtgggggaccttcgggcctcatgccatcagatgtgcccaga<br>tgggattagctagtaggtggggtaacggctcacctaggcgacgatccctagctggtctgagaggatgaccagccacac<br>tggaactgagacacggtccagactcctacgggaggcagcagtggggaatattgcacaatgggcgcaagcctgatgc<br>agccatgccgcgtgtgtgaagaaggccttcgggttgtaaagcactttcagcggggaggaaggcggtgaggttaataac<br>cttggcgattgacgttacccgcagaagaagcaccggctaactccgtgccagcagccgcggtaatacggagggtgcaa<br>gcgttaatcggaattactgggcgtaaagcgcacgcaggcggtctgtcaagtcggatgtgaaatccccgggctcaacct<br>gggaactgcattcgaaactggcaggctagagtcttgtagaggggggtagaattccaggtgtagcggtgaaatgcgtag<br>agatctggaggaataccggtggcgaaggcggcccctggacaaagactgacgctcaggtgcgaaagcgtggggag<br>caaacaggattagataccctggtagtccacgccgtaaacgatgtcgatttggaggttgtgcccttgaggcgtggcttccg<br>gagctaacgcgttaaatcgaccgcctggggagtacggccgcaaggttaaaactcaaatgaattgacgggggcccgca<br>caagcggtggagcatgtggtttaattcgatgcaacgcgaagaaccttacctggtcttgacatccacagaacttagcaga<br>gatgctttggtgccttcgggaactgtgagacaggtgctgcatggctgtcgtcagctcgtgttgtgaaatgttgggttaagt<br>cccgcaacgagcgcaacccttatccatgttgccagcggtccggccgggaactcaaaggagactgccagtgataaact<br>ggaggaaggtggggatgacgtcaagtcatcatggccatacgaccagggctacacacgtgctacaatggcatatacaa<br>agagaagcgacctcgcgagagcaagcggacctcataaagtatgtcgtagtccggattggagtctgcaactcgactcca<br>tgaagtcggaatcgctagtaatcgtagatcagaatgctacggtgaatacgttcccgggccttgtacacaccgcccgtca<br>caccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Klebsiella_pneumoniae* | SEQ ID NO: 400 | ttgaagagatgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataacgtcgcaagaccaaagtgggggaccttcgggcctcatgccatcagatgtgcccag<br>atgggattagctagtaggtggggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtgtgaagaaggccttcgggagtaaagcactacagcggggaggaaggcggtgaggttaataa<br>cctcatcgattgacgttacccgcagaagaagcaccggctaactccgtgccagcagccgcggtaatacggagggtgca<br>agcgttaatcggaattactgggcgtaaagcgcacgcaggcggtctgtcaagtcggatgtgaaatccccgggcttaacct<br>gggaactgcattcgaaactggcaggctagagtcttgtagaggggggtagaattccaggtgtagcggtgaaatgcgtag<br>agatctggaggaataccggtggcgaaggcggcccctggacaaagactgacgctcaggtgcgaaagcgtggggag<br>caaacaggattagataccctggtagtccacgccgtaaacgatgtcgataggaggttgtgcccttgaggcgtggatccg<br>gagctaacgcgttaaatcgaccgcctggggagtacggccgcaaggttaaaactcaaatgaattgacgggggcccgca<br>caagcggtggagcatgtggtttaattcgatgcaacgcgaagaaccttacctggtcttgacatccacagaactttccagag<br>atggattggtgccttcgggaactgtgagacaggtgctgcatggctgtcgtcagctcgtgttgtgaaatgttgggttaagtc |

TABLE 6-continued

| Species Name | Sequence Identifier | 16S sequence |
|---|---|---|
| | | Full length 16S rDNA sequences of species (positive correlates) |
| | | ccgcaacgagcgcaacccttatcctagttgccagcggtccggccgggaactcaaaggagactgccagtgataaactg<br>gaggaaggtggggatgacgtcaagtcatcatggcccttacgaccagggctacacacgtgctacaatggcatatacaaa<br>gagaagcgacctcgcgagagcaagcggacctcataaagtatgtcgtagtccggattggagtctgcaactcgactccat<br>gaagtcggaatcgctagtaatcgtagatcagaatgctacggtgaatacgttcccgggccttgtacacaccgcccgtcac<br>accatgggagtgggagcaaaagaagtaggtagcttaaccttcgggagggcgcttaccactagtgattcatgactggg<br>gtgaagtcgtaacaaggtaaccgtaggggaacctgcggttggatcacctcctt |
| *Klebsiella_pneumoniae* | SEQ ID NO: 401 | ttgaagagtttgatcatggctcagattgaacgctggcggcaggcctaacacatgcaagtcgagcggtagcacagagag<br>cttgctctcgggtgacgagcggcggacgggtgagtaatgtctgggaaactgcctgatggagggggataactactgga<br>aacggtagctaataccgcataatgtcgcaagaccaaagtgggggaccttcgggcctcatgccatcagatgtgcccaga<br>tgggattagcttgtaggtggggtaacggctcacctaggcgacgatccctagctggtctgagaggatgaccagccacac<br>tggaactgagacacggtccagactcctacgggaggcagcagtggggaatattgcacaatgggcgcaagcctgatgc<br>agccatgccgcgtgtgtgaagaaggccttcgggttgtaaagcactttcagcggggaggaaggcggtgaggttaataac<br>ctcatcgattgacgttacccgcagaagaagcaccggctaactccgtgccagcagccgcggtaatacggagggtgcaa<br>gcgttaatcggaattactgggcgtaaagcgcacgcaggcggtctgtcaagtcggatgtgaaatccccgggctcaacct<br>gggaactgcattcgaaactggcaggctagagtcttgtagaggggggtagaattccaggtgtagcggtgaaatgcgtag<br>agatctggaggaataccggtggcgaaggcggccccctggacaaagactgacgctcaggtgcgaaagcgtggggag<br>caaacaggattagataccctggtagtccacgccgtaaacgatgtcgataggaggttgtgcccttgaggcgtggatccg<br>gagctaacgcgttaaatcgaccgcctggggagtacggccgcaaggttaaaactcaaatgaattgacgggggcccgca<br>caagcggtggagcatgtggtttaattcgatgcaacgcgaagaaccttacctggtcttgacatccacagaacttagcaga<br>gatgctttggtgccttcgggaactgtgagacaggtgctgcatggctgtcgtcagctcgtgagtgaaatgttgggttaagt<br>cccgcaacgagcgcaacccttatcctagttgccagcggtccggccgggaactcaaaggagactgccagtgataaact<br>ggaggaaggtggggatgacgtcaagtcatcatggcccttacgaccagggctacacacgtgctacaatggcatatacaa<br>agagaagcgacctcgcgagagcaagcggacctcataaagtatgtcgtagtccggattggagtctgcaactcgactcca<br>tgaagtcggaatcgctagtaatcgtagatcagaatgctacggtgaatacgttttccgggccagtacacaccgcccgtca<br>caccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |
| *Klebsiella_pneumoniae* | SEQ ID NO: 402 | ttgaagagtttgatcatggctcagattgaacgctggcggcaggcctaacacatgcaagtcgagcggtagcacagagag<br>cagctctcgggtgacgagcggcggacgggtgagtaatgtctgggaaactgcctgatggagggggataactactgga<br>aacggtagctaataccgcataacgtcgcaagaccaaagtgggggaccttcgggcctcatgccatcagatgtgcccag<br>atgggattagctagtaggtggggtaacggctcacctaggcgacgatccctagctggtctgagaggatgaccagccaca<br>ctggaactgagacacggtccagactcctacgggaggcagcagtggggaatattgcacaatgggcgcaagcctgatg<br>cagccatgccgcgtgtgtgaagaaggccttcgggttgtaaagcactttcagcggggaggaaggcgttaaggttaataa<br>cctcatcgattgacgttacccgcagaagaagcaccggctaactccgtgccagcagccgcggtaatacggagggtgca<br>agcgttaatcggaattactgggcgtaaagcgcacgcaggcggtctgtcaagtcggatgtgaaatccccgggctcaacc<br>tgggaactgcattcgaaactggcaggctagagtcttgtagaggggggtagaattccaggtgtagcggtgaaatgcgta<br>gagatctggaggaataccggtggcgaaggcggccccctggacaaagactgacgctcaggtgcgaaagcgtgggga<br>gcaaacaggattagataccctggtagtccacgccgtaaacgatgtcgatttggaggttgtgcccttgaggcgtggcttcc<br>ggagctaacgcgttaaatcgaccgcctggggagtacggccgcaaggttaaaactcaaatgaattgacgggggcccgc<br>acaagcggtggagcatgtggtttaattcgatgcaacgcgaagaaccttacctggtcttgacatccacagaacttagcag<br>agatgctttggtgccttcgggaactgtgagacaggtgctgcatggctgtcgtcagctcgtgttgtgaaatgttgggttaag<br>tcccgcaacgagcgcaacccttatcctttgttgccagcggtccggccgggaactcaaaggagactgccagtgataaac<br>tggaggaaggtggggatgacgtcaagtcatcatggcccttacgaccagggctacacacgtgctacaatggcatataca<br>aagagaagcgacctcgcgagagcaagcggacctcataaagtatgtcgtagtccggattggagtctgcaactcgactcc<br>atgaagtcggaatcgctagtaatcgtagatcagaatgctacggtgaatacgttcccgggccttgtacacaccgcccgtc<br>acaccatgggagtgggttgcaaaagaagtaggtagcttaaccttcgggagggcgcttaccactttgtgattcatgactgg<br>ggtgaagtcgtaacaaggtaaccgtaggggaacctgcggttggatcacctcctt |

TABLE 6-continued

Full length 16S rDNA sequences of species (positive correlates)

| Species Name | Sequence Identifier | 16S sequence |
| --- | --- | --- |
| *Fusobacterium_ nucleatum* | SEQ ID NO: 403 | gctcaccaaggcgatgatgggtagccggcctgagagggtgatcggccacaaggggactgagacacggcccttactc<br>ctacgggaggcagcagtggggaatattggacaatggaccaagagtctgatccagcaattctgtgtgcacgatgaagttt<br>ttcggaatgtaaagtgctttcagttgggaagaaaaaaatgacggtaccaacagaagaagtgacggctaaatacgtgcca<br>gcagccgcggtaatacgtatgtcacaagcgttatccggatttattgggcgtaaagcgcgtctaggtggttatgtaagtctg<br>atgtgaaaatgcagggctcaactctgtattgcgttggaaactgtgtaactagagtactggagaggtaagcggaactaca<br>agtgtagaggtgaaattcgtagatatttgtaggaatgccgatggggaagccagcttactggacagatactgacgctgaa<br>gcgcgaaagcgtgggtagcaaacaggattagataccctggtagtccacgccgtaaacgatgattactaggtgttgggg<br>gtcgaacctcagcgcccaagcaaacgcgataagtaatccgcctggggagtacgtacgcaagtatgaaactcaaagga<br>attgacggggacccgcacaagcggtggagcatgtggtttaattcgacgcaacgcgaggaaccttaccagcgtttgaca<br>tcttaggaatgagacagagatgtttcagtgtcccttcggggaaacctaaagacaggtggtgcatggctgtcgtcagctcg<br>tgtcgtgagatgttgggttaagtcccgcaacgagcgcaacccctttcgtatgttaccatcattaagttggggactcatgcg<br>atactgcctgcgatgagcaggaggaaggtggggatgacgtcaagtcatcatgccccttatacgctgggctacacacgt<br>gctacaatgggtagtacagagagtcgcaaagccgtgaggtggagctaatctcagaaaactattcttagttcggattgtac<br>tctgcaactcgagtacatgaagttggaatcgctagtaatcgcgaatcagcaatgtcgcggtgaatacgttctcgggtcttg<br>tacacaccgcccgtcacaccacgagagttggttgcacctgaagtagcaggcctaaccgtaaggagggatgctccgag<br>ggtgtgattagcgattggggtgaagtcgtaacaaggtatccgtacgggaacgtgcggatggatcacctcctt |
| *Butyrivibrio_sp.* | SEQ ID NO: 404 | ttgagagtttgatcctggctcaggatgaacgctggcggcgtgcttaacacatgcaagtcgaacggacggattggagctt<br>gctccatgaagttagtggcggacgggtgagtaacgcgtgggtaacctgccctatgcaggggggataacgtttggaaacg<br>aacgctaataccgcataacctagttggttcgcatgaaccgactagcaaagattttatcggcataggatggacccgcgttg<br>gattagctagttggtgagataacagcccaccaaggcaacgatccatagccggcctgagagggtgaacggccacactg<br>ggactgagacacggcccagactcctacgggaggcagcagtggggaatattgcacaatgggcgcaagcctgatgcag<br>cgacgccgcgtgaaggatgaaggtcttcggatcgtaaacttctatcagcagggaagaaaccatgacggtacctgacta<br>agaagccccggctaactacgtgccagcagccgcggtaatacgtagggggcaagcgttatccggaattactgggtgta<br>aagggtgcgtaggcggcgatttaagtcagatgtgaaaactcagggctcaaccttgagactgcatctgaaactgagttgc<br>tagagtgcaggagaggaaagcggaattccgagtgtagcggtgaaatgcgtagagattcggaggaacaccagtagcg<br>aaggcggctttctggactgtaactgacgctgaggcacgaaagcgtggggagcgaacaggattagataccctggtagt<br>ccacgccgtaaacgatgaatactaggtgtcggggcttacgggtctcggtgccgcagctaacgcattaagtattccacct<br>gggaagtacgaccgcaaggttgaaactcaaaggaattgacggggacccgcacaagcggtggagcatgtggtttaatt<br>cgaagcaacgcgaagaaccttacctaaacttgacatccctttgaccggtccttaatcggatctttactagcttgctagtaca<br>aaggtgacaggtggtgcatggagtcgtcagctcgtgtcgtgagatgagggttaagtcccgcaacgagcgcaacccct<br>atctttagtagccatcattcagttgggcactctagagagactgccagggataacctggaggaaggtggggatgacgtca<br>aatcatcatgccccttatgtttagggctacacacgtgctacaatgggtgctacaaagggaagcaaatccgcgaggccga<br>gcaaatctcaaaaaagcactcccagttcggattgtagtctgcaactcgactacatgaagttggaatcgctagtaatcgcg<br>aatcagaatgtcgcggtgaatacgttcccgggtcagtacacaccgcccgtcacaccatgggagagggggggcccaa<br>cgccagtgacctaacccgcaagggaaggagctgtctaaggcaaaaccaatgactggggtgaagtcgtaacaaggta<br>gccgtatcggaaggtgcggctggatcacctccttt |
| *Ruminococcus_obeum* | SEQ ID NO: 405 | cctacgggaggcagcagtggggaatattgcacaatgggggaaaccctgatgcagcgacgccgcgtgaaggaagaa<br>gtatctcggtatgtaaacttctatcagcagggaagatagtgacggtacctgactaagaagccccggctaactacgtgcc<br>agcagccgcggtaatacgtagggggcaagcgttatccggatttactgggtgtaaagggagcgtagacggactggcaa<br>gtctgatgtgaaaggcgggggctcaacccctggactgcattggaaactgttagtcttgagtgccggagaggtaagcgg<br>aattcctagtgtagcggtgaaatgcgtagatattaggaggaacaccagtggcgaaggcggcttactggacggtaactg<br>acgttgaggctcgaaagcgtggggagcaaacaggattagataccctggtagtccacgccgtaaacgatgaatactag<br>gtgttggggagcaaagctcttcggtgccgccgcaaacgcattaagtattccacctggggagtacgttcgcaagaatgaa<br>actcaaaggaattgacggggacccgcacaagcggtggagcatgtggtttaattcgaagcaacgcgaagaaccttacc<br>aagtcttgacatccctctgaccgactataaccgagtattccttcgggacagaggagacaggtggtgcatggttgtcgtc |

TABLE 6-continued

| Full length 16S rDNA sequences of species (positive correlates) | | |
|---|---|---|
| Species Name | Sequence Identifier | 16S sequence |
| | | agctcgtgtcgtgagatgttgggttaagtcccgcaacgagcgcaacccctatccccagtagccagcggttcggccggg cactctgaggagactgccagggataacctggaggaaggcggggatgacgtcaaatcatcatgccccttatgatttggg ctacacacgtgctacaatggcgtaaacaaagggaagcaagcctgcgaaggtaagcaaatcccaaaaataacgtccca gttcggactgcagtctgcaactcgactgcacgaagctggaatcgctagtaatcgcggatcagaatgccgcggtgaata cgttcccgggtcttgtacacaccgcccgtcacaccatgggagtcagtaacgcccgaagtcagtgacctaaccgcaagg gaggagctgccgaaggcgggaccgatgactggggtgaagtcgtaacaaggtagccgtatcggaaggtgcggctgg atcacctccttt |

Example 3: Human Studies—Ulcerative Colitis

Human subjects having mild-moderate ulcerative colitis received placebo only (Arm A), weekly doses of enriched and purified spores prepared from the stool of healthy, screened humans (Arm B), a short course of vancomycin followed by weekly administration of the spores (Arm D), or a short course of vancomycin followed by daily administration of the spores (Arm C).

Figure 3:
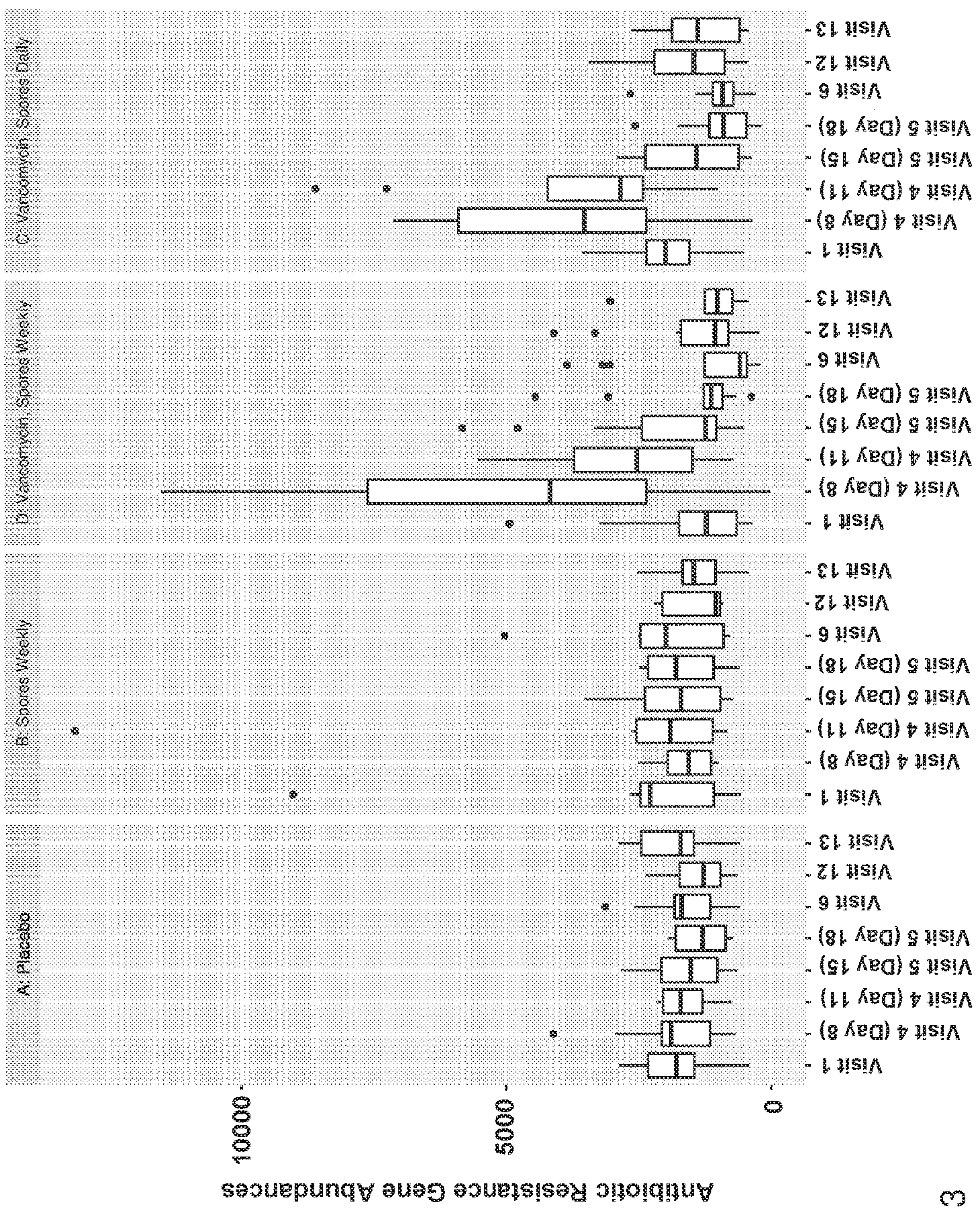
FIG. 3 is a graph showing the abundance of antibiotic resistance genes per time point (x-axis), faceted by cohort (A: placebo, B: spore prepared from the stool of healthy, screened humans, weekly, D: vancomycin, spore preparation weekly, and C: vancomycin, spore preparation daily.

As antibiotics are not the standard of care for ulcerative colitis, this population of subjects is less likely to have been frequently treated with antibiotics as compared to the multiply recurrent *C. difficile* population (Example 1, above). Therefore, the microbiomes of ulcerative colitis subjects have experienced fewer periods of strong selection for antibiotic resistance. At the pre-antibiotic baseline sample (Visit 1, FIG. 3) we observed a low abundance of antibiotic resistance genes.

The results show that AbxR gene abundances are lower in post-treated time points as compared to post antibiotics baseline samples (Visit 4, day 8). In Arms C and D, treatment with vancomycin results in a spike in antibiotic resistance genes post-treatment (Visit 4, day 8). Treatment with spores daily or weekly resulted in a significant reduction in antibiotic resistance genes at Visit 5 (day 15, 7 days after spore dosing commenced) relative to post-antibiotic baseline (Visit 4, Table 7).

TABLE 7

AbxR gene abundances are lower in select post-treated time points as compared to post antibiotics baseline samples (Visit 4, day 8).

| | Arm | Day 11 (3 days post - treatment) < Day 8 (post vancomycin) | Day 15 (7 days post treatment) < Day 8 (post vancomycin) |
|---|---|---|---|
| Wilcox test p-values (one sided paired test) | D (spores weekly after vancomycin) | 0.01367 | 0.03223 |
| Wilcox test p-value (one sided paired test) vancomycin) | C (spores daily after | 0.6562 | 0.009766 |

AbxR gene abundances are lower in post-treated time points as compared to pre-antibiotic baseline samples (Visit 1). In Arms C and D, treatment with spores resulted in reduction in antibiotic resistance genes relative to pre-antibiotic baseline (Visit 1, Table 8, FIG. 3). Treatment with spores daily resulted in a significant reduction in antibiotic resistance genes at Visit 5 and Visit 6 (day 18, day 28, respectively) relative to pre-antibiotic baseline (Visit 1, Table 8).

TABLE 8

Treatment with spores resulted in reduction of AbxR gene abundance relative to pre-antibiotic baseline (e.g. Visit 1 (pre-antibiotic) vs (Visit 5 or Visit 6)).

| | Arms | Visit 5 (day 18) | Visit 6 |
|---|---|---|---|
| Wilcox test p-values (one sided paired test) | D (spores weekly after vancomycin) | 0.1826 | 0.1902 |
| Wilcox test p-value (one sided paired test) | C (spores daily after vancomycin) | 0.01367 | 0.04199 |

Figure 4:
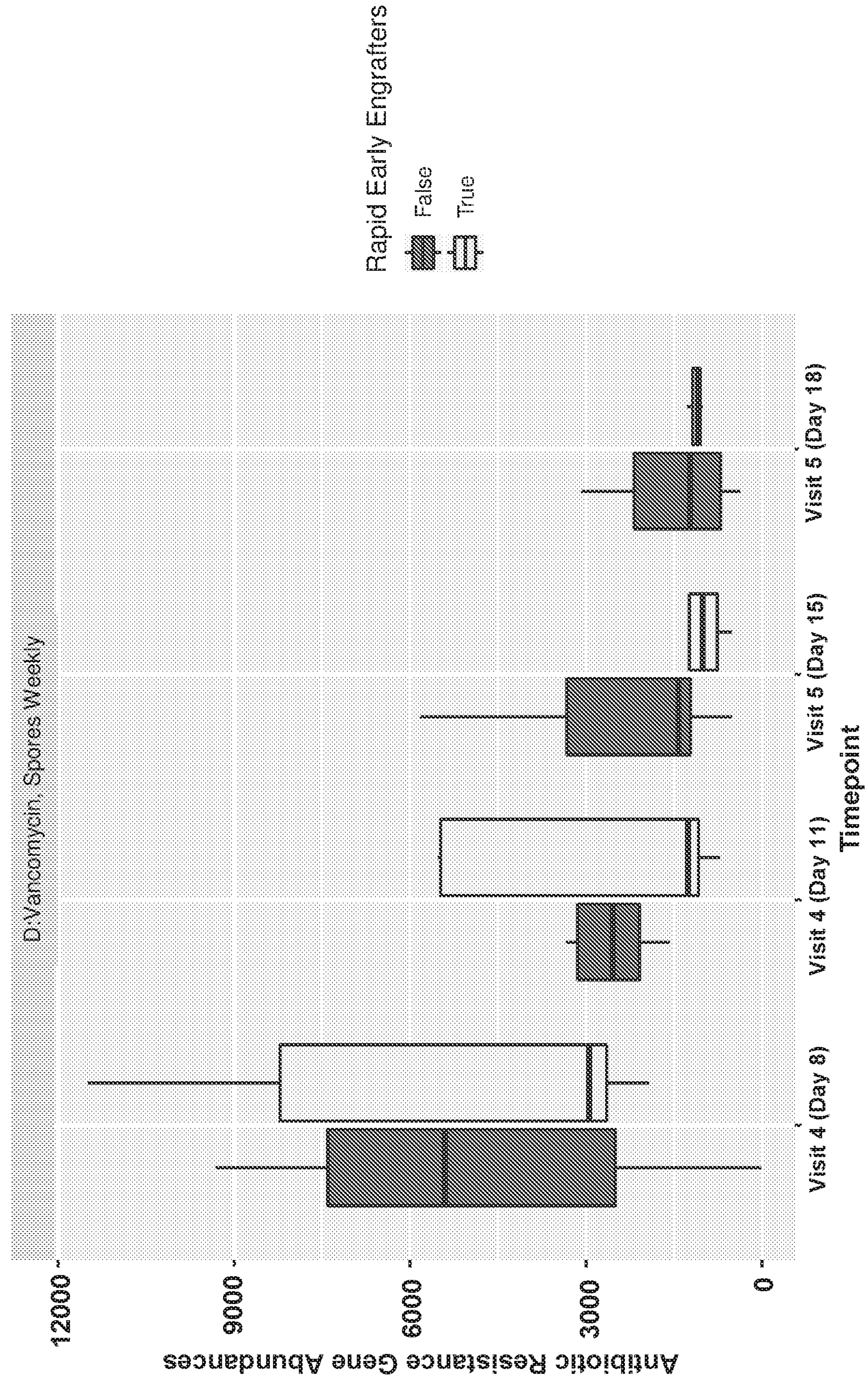
FIG. 4 is a graph showing that in subjects with rapid, early engraftment with spore preparation in Arm D (Vancomycin, spore preparation Weekly), antibiotic resistance genes decreased more rapidly as compared to subjects who did not exhibit rapid, early engraftment. Visit 4 (day 8) is immediately following cessation of antibiotics, and Visit 4 (day 11) is the first spore preparation time point.

The results show that engraftment of spores drives reduced antibiotic resistance. In Arm D (weekly dosing), spores engrafted rapidly in a subset of subjects (Rapid Early Engrafters=True, FIG. 4). In the remaining subjects, engraftment was reduced in magnitude or timing (Rapid Early Engrafters=False, FIG. 4). "Rapid Early Engrafters" were defined as subjects with more than 6 dosed spore formers detected at visit 5 (Day 15). We observed that these rapid early engrafting subjects displayed significantly lower AbxR gene abundances at Visit 5 (day 15) as compared to those not identified as rapid early engrafters at Visit 5 (day 15, 7 days after first dose of spores).

TABLE 9

Within the same time point AbxR gene abundances are lower in rapid engrafting subjects as compared to non-rapid engrafters, Arm D (weekly dosing).

| | Day 8 (pre-treatment) | Day 11 (3 days post-treatment) | Day 15 (6 days post treatment) |
|---|---|---|---|
| Wilcox test p-value (alternative = "less") | 0.6548 | 0.3312 | 0.07343 |

Example 4: Animal Models

One method of testing a ROAR composition for the ability to reduce antibiotic resistance uses conventional mice (laboratory strains that have a microbiome). The mice are treated with selected antibiotics, then colonized with bacteria harboring one or more antibiotic resistance genes, for example, vancomycin resistant bacteria (vancomycin resistant *Enterococcus*; VRE) or vancomycin and carbapenem resistant bacteria (carbapenem resistant Enterobacteriaceae; CRE). Following colonization, the mice are treated with a ROAR composition, fecal transplant, or control. Titers of antibiotic resistant bacteria (for example, vancomycin resistant and carbapenem resistant bacteria) are monitored via plating of stool collected from treated animals.

Applicants have established a reproducible and robust vancomycin-resistant enterococci (VRE) colonization model in mice based on a published model (Caballero and Pamer, 2015, Ann Rev Immunol 33:227-256). Prior to VRE inoculation, specific pathogen free (SPF) mice are preconditioned with ampicillin to disrupt colonization resistance and allow VRE colonization. Following ampicillin treatment, mice are challenged with VRE and achieve high titer ($10^7$ to $10^{10}$ CFU/g feces) carriage in the GI tract, a condition that is stable for multiple weeks. Once colonized with VRE, mice are treated with a human FMT or a ROAR resistance composition via daily oral gavage for 3 days. Fresh fecal samples are collected throughout the study to evaluate the ability of compositions to clear VRE from the mice and restore a healthy gut microbiome. VRE viable titers in feces pre- and post-treatment are determined by plating on selective media that contains bile esculin azide agar with vancomycin and streptomycin. The VRE colonization model is able to detect a >4 log difference in colonization over 3 weeks in mice treated with human FMT compared to mice treated only with PBS. The ability to detect a >4 log difference in VRE titers during the study window has also distinguished designed microbial compositions with differential potency. In addition, the abundance of antibiotic resistance genes can be assayed. Carbapenem-resistant Enterobacteriaceae (CRE) resistance can be tested in a similar way, substituting selective media appropriate for CRE.

Using such models, a ROAR composition can be tested for its effects on the abundance of antibiotic resistance genes. A ROAR composition that can reduce the abundance of one or more antibiotic resistance genes in this model is useful for the methods described herein.

Various embodiments of the invention are within the following numbered paragraphs.

1. A method of reducing the abundance of at least one antibiotic-resistance gene in the microbiome of a subject, the method comprising administering a therapeutically effective amount of a microbiome composition comprising spore-former bacteria.
2. A method of treating a subject at risk for or diagnosed with an undesirable level or population of drug-resistant bacteria, the method comprising administering a therapeutically effective amount of a microbiome composition comprising *Firmicutes* derived from one or more healthy human subjects.
3. A method of reducing the abundance of antibiotic-resistant bacteria in the microbiome of a subject, the method comprising administering a therapeutically effective amount of a ROAR composition.
4. A method of disrupting a transmission cycle of antibiotic resistance genes, the method comprising administering a ROAR composition to at least two individuals with a high likelihood of direct or indirect contact including contact with a bodily fluid or waste.
5. The method of paragraph 1, wherein the antibiotic-resistance gene(s) is selected from those listed in Table 1.
6. The method of paragraph 5, wherein the abundance of at least 2, 3, 4, 5, 6, 7, 8, 9, 10, or more antibiotic resistance genes of Table 1 is reduced.
7. The method of any one of paragraphs 1 to 6, wherein the drug or antibiotic is from a drug class listed in Table 2.
8. The method of any one of paragraphs 1 to 7, further comprising reducing the abundance of 1, 2, 3, 4, 5, 6, 7, 8, 9, 10, 11, 12, 13, 14, 15, 16, 17, 18, 19, 20, 21, 22, 23, 24, 25, or more antibiotic resistant genes or drug classes.
9. The method of any one of paragraphs 1 to 8, wherein the administered composition comprises one or more species listed in Table 3.
10. The method of paragraph 9, wherein the administered composition comprises 2, 3, 4, 5, 6, 7, 8, 9, 10, 11, 12, 13, 14, 15, 16, 17, 18, 19, 20, or more species listed in Table 3.
11. The method of paragraph 9 or 10, wherein the administered species comprises a 16S rDNA, V4, and/or V6 sequence listed in Table 5, or a sequence having at least 95% identity thereto.
12. The method of any one of paragraphs 1 to 11, wherein the administered composition does not comprise one or more species of Table 4.
13. The method of any one of paragraphs 1 to 12, wherein the bacteria in the composition are in the form of spores.
14. The method of any one of paragraphs 1 to 13, wherein the bacteria in the composition are cultured.
15. The method of any one of paragraphs 1 to 14, wherein the composition comprises *Firmicutes* and one or more species of *Bacteroides.*
16. The method of any one of paragraphs 1 to 15, wherein the subject has a reduced abundance of one, two, or three bacteria selected from the group consisting of quinolone resistant, beta-lactam-resistant, and carbapenem-resistant bacteria.
17. The method of any one of paragraphs 1 to 16, wherein the subject has been unresponsive to antibiotic treatment.
18. The method of any one of paragraphs 1 to 17, wherein the subject has or is at risk of developing *C. difficile* infection.
19. The method of any one of paragraphs 1 to 18, wherein the subject has or is at risk of developing a colitis.
20. The method of paragraph 19, wherein the colitis is Crohn's disease or ulcerative colitis.
21. The method of paragraph 20, wherein the colitis is mild to moderate ulcerative colitis.
22. A composition comprising bacterial species associated with a decrease in the abundance of at least one antibiotic resistance gene in a subject.
23. The composition of paragraph 22, wherein the antibiotic-resistance gene(s) is selected from those listed in Table 1.
24. The composition of paragraph 23, wherein the abundance of at least 2, 3, 4, 5, 6, 7, 8, 9, 10, or more antibiotic resistance genes of Table 1 is decreased.
25. The composition of any one of paragraphs 22 to 24, wherein the antibiotic is from a class listed in Table 2.
26. The composition of any one of paragraphs 22 to 25, wherein the composition comprises one or more species listed in Table 3.
27. The composition of paragraph 26, wherein the composition comprises 2, 3, 4, 5, 6, 7, 8, 9, 10, 11, 12, 13, 14, 15, 16, 17, 18, 19, 20, or more species listed in Table 3.
28. The composition of paragraph 20 or 27, wherein the species comprises a 16S rDNA, V4, and/or V6 sequence listed in Table 5, or a sequence having at least 95% identity thereto.
29. The composition of any one of paragraphs 22 to 28, wherein the composition does not comprise one or more species of Table 4, and optionally the one or more species of Table 4 comprises a 16S rDNA, V4, and/or V6 sequence listed in Table 6, or a sequence having at least 95% identity thereto.
30. The composition of any one of paragraphs 22 to 29, wherein the composition comprises one or more species of *Firmicutes.*
31. The composition of any one of paragraphs 22 to 30, wherein the composition comprises one or more species of *Bacteroides.*
32. The composition of any one of paragraphs 22 to 31, wherein the bacteria in the composition are in the form of spores.

33. The composition of any one of paragraphs 22 to 32, wherein the bacteria in the composition are obtained from a spore fraction derived from feces of a healthy subject.
34. The composition of any one of paragraphs 22 to 33, wherein the composition comprises one or more species of *Firmicutes*, and optionally one or more species of *Bacteroides*, as the sole bacterial species in the composition.
35. The composition of any one of paragraphs 22 to 34, wherein the bacteria in the composition are cultured.
36. A composition comprising bacteria for use in decreasing the abundance of at least one antibiotic resistance gene in a subject to whom the composition is administered.
37. The composition of paragraph 36, wherein the bacteria in the composition are obtained from a spore fraction derived from feces of a healthy subject.
38. The composition of paragraph 36, wherein the bacteria are selected for being associated with a decrease in the abundance of one or more antibiotic resistance genes in a subject.
39. The composition of any one of paragraphs 36 to 38, wherein the antibiotic resistance gene(s) is selected from Table 1.
40. The composition of any one of paragraphs 36 to 39, wherein the composition comprises at least one species selected from Table 3.
41. The composition of any one of paragraphs 36 to 40, wherein the composition does not comprise a species of Table 4.
42. A method for identifying a bacterial composition useful for decreasing the abundance of at least one antibiotic resistance gene in a subject to whom the composition is administered, the method comprising screening the composition for the presence of one or more bacterial species of Table 3, wherein detection of one or more species of Table 3 in the bacterial composition indicates the identification of a composition that can be used to decrease the abundance of at least one antibiotic resistance gene.
43. The method of paragraph 42, wherein the screening comprises detection of one or more 16S rDNA, V4, and/or V6 sequences of Table 5 in the composition, or a sequence having at least 95% identity thereto.
44. The method of paragraph 42 or 43, further comprising screening for the presence of one or more bacterial species of Table 4, and optionally the one or more species of Table 4 comprises a 16S rDNA, V4, and/or V6 sequence listed in Table 6, or a sequence having at least 95% identity thereto.
45. A method for screening a potential donor of feces for use in therapeutic methods, the method comprising testing a feces sample from the potential donor for the presence of a bacterial species from Table 3 or Table 4, wherein detection of one or more species from Table 3 indicates that the potential donor may proceed to become a donor, while detection of one or more species from Table 4 indicates that the potential donor should not become a donor.
46. A method for determining whether a subject could benefit from treatment with a ROAR composition, the method comprising determining whether a sample from the subject comprises one or more species of bacteria from Table 4, wherein detection of one or more species from Table 4 indicates that the subject may benefit from treatment with a ROAR composition.
47. A composition of any one of paragraphs 22 to 41, wherein the bacteria in the composition demonstrate the ability to decrease the abundance of one or more antibiotic resistance gene(s) in an animal model of antibiotic resistance.
48. The composition of paragraph 47, wherein the animal model comprises a mouse treated with one or more antibiotics and then colonized with one or more bacteria harboring one or more antibiotic resistance genes.
49. The composition of paragraph 48, wherein the mice are colonized with vancomycin resistant bacteria or vancomycin and carbapenem resistant bacteria.

Other embodiments are within the scope of the following claims.

SEQUENCE LISTING (405 sequences)

SEQ ID NO: 1 - DNA, 869 bp, Clostridium difficile
ttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttca

SEQ ID NO: 2 - DNA, 869 bp, Clostridium difficile; identical to SEQ ID NO: 1

SEQ ID NO: 3 - DNA, 869 bp, Clostridium difficile; identical to SEQ ID NO: 1

SEQ ID NO: 4 - DNA, 1530 bp, Fusicatenibacter_saccharivorans
tcagagagtttgatcctggctcaggatgaacgctggcggcgtgcttaacacatgcaagtcgagcgaagcagttaagttgatttcttcggattgattcttgactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggctttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctccttt

SEQ ID NO: 5 - DNA, 1530 bp, Lachnospira pectinoschiza
ttatgagagtttgatcctggctcaggatgaacgctggcggcgtgcttaacacatgcaagtcgaacgaagcatttaagacagattacttcggtttgaagtcttttatgactgagtggcggacgggtgagtaacgcgtgggtaacctgcctcatacagggggatagcagctggaaacggctggtaataccgcataagcgcacagtaccacatggtacagtgtgaaaaactccggtggtatgagatggacccgcgtctgattagcttgttggcggggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtagttcgctatgtaaagctctatcagcagggaagatagtgacggtacctgactaagaagctccggctaaatacgtgccagcagccgcggtaatacgtatggagcaagcgttatccggatttactgggtgtaaagggagtgtaggtggccaggcaagtcagaagtgaaagcccggggctcaaccccgggactgcttttgaaactgcagggctagagtgcaggaggggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggcacataagtgctccggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtgaccttttcttcggaacaagagtgacaggtggtgcatggttgtcgtcagctcgtgtcgtgagatgttgggttaagtcccgcaacgagcgcaacccttatccttagtagccagcagttcggctgggcactctagggagactgccagggataacctggaggaaggtggggatgacgtcaaatcatcatgccccttatgacttgggctacacacgtgctacaatggcgtaaacaaagtgaagcgagagcgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaacgtaagaaggagccgccgaaggcaggtctgataactggggtgaagtcgtaacaaggtagccgtatcggaaggtgcggctggatcacctccttt

SEQ ID NO: 6 - DNA, 1305 bp, Clostridium_sp.
tccggtggtatgagatggacccgcgtctgattagctagttggtgaggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctccttt

SEQ ID NO: 7 - DNA, 1528 bp, Ruminococcus_sp.
tacgagagtttgatcctggctcaggatgaacgctggcggcgtgcttaacacatgcaagtcgaacgaagcacttaagtttgattcttcggatgaagacttttgtgactgagtggcggacgggtgagtaacgcgtgggtaacctgcctcatacagggggataacagttagaaatggctgctaataccgcataagaccacagcaccgcatggtgcaggggtaaaaactccggtggtatgagatggacccgcgtctgattagctggttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtatggcaagtctgatgtgaaaggccagggctcaaccctgggactgcattggaaactgtcgaactagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcagagctattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtacggccgggcactctagagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 8 - DNA, 1530 bp, Clostridium_sp.
tttagagagtttgatcctggctcaggatgaacgctggcggcgtgcttaacacatgcaagtcgagcgaagcacttatggagattcttcggatgatccatttgtgactgagcggcggacgggtgagtaacgcgtgagtaacctgcctcatacaggggaataacagttagaaatgactgctaatgccgcataagcgcacagggccacatggcctggtgtgaaaaactccggtggtatgagatggactcgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctttgcaagtctgacgtgaaaatccggggctcaaccccggaactgcgttggaaactgtgaggcttgagtgccggagaggtaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgcggtaaacgatgaatactaggtgttgggggacaaagtccttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcgattcgccgggactgtaatgagtcctttcccttcggggacgaagaagacaggtggtgcatggttgtcgtcagctcgtgtcgtgagatgttgggttaagtcccgcaacgagcgcaacccttatcttcagtagccagcaagtgaagttgggcactctggagagactgccagggacaacctggaggaaggtggggatgacgtcaaatcatcatgccccttatgacttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggtaacgcccgaagtcagtgacccaaccgaaaggagggagctgccgaaggcgggactggtaactggggtgaagtcgtaacaaggtagccgtatcggaaggtgcggctggatcacctccttt

SEQ ID NO: 9 - DNA, 1306 bp, Blautia_faecis
ctccggtggtataagatggacccgcgttggattagctagttggcagggcagcggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtctgggagcacagctcttaggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgacagagtatgtaatgtacttttccttcgggacaggggagacaggtggtgcatggttgtcgtcagctcgtgtcgtgagatgttgggttaagtcccgcaacgagcgcaacccctatccttagtagccagcaagtaatgttgggcactctgaggagactgccagggataacctggaggaaggcggggatgacgtcaaatcatcatgccccttatgatttgggctacacacgtgctacaatggcgtaaacaaagggaagcgaacctgtgagggtgggcaaatctcaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgtaaggaaggagctgccgaaggcgggacggatgactggggtgaagtcgtaacaaggtagccgtatcggaaggtgcggctggatcacctccttt

SEQ ID NO: 10 - DNA, 1522 bp, Clostridium_sp.
taaagagtttgatcctggctcaggacgaacgctgtcggcgcgcctaacacatgcaagtcgaacgaagttgctttgaatgaattcttcggaaggaatttgattcaacttagtggcggacgggtgagtaacgcgtgagtaacctgcctttcagagggggataacgtctggaaacggacgctaataccgcataacatattggtttcgcatggagctgatatcaaaggagcaatccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgagtgagggaagaaggttttcggattgtaaacctctgtccttggtgaagataatgacggtaaccaaggaggaagctacggctaactacgtgccagcagccgcggtaatacgtaggtagcgagcgttgtccggaattactgggtgtaaagggagcgtaggcgggattgcaagttgaatgttaaatctatgggctcaacccatagccgcgttcaaaactgcagttcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacaggattagataccctggtagtccacgctgtaaacgatgattactaggtgtggggggactgaccccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccggtgcatagcctagagataggtgaagcccttcggggcaccgagacaggtggtgcatggttgtcgtcagctcgtgtcgtgagatgttgggttaagtcccgcaacgagcgcaacccttacgtttagttgctacgcaagagcactctagacggactgccgttgacaaaacggaggaaggtggggatgacgtcaaatcatcatgccccttatgacctgggctacacacgtactacaatggctattaacagagggaagcaagatggtgacatggagcaaacccctaaaaatagtctcagttcggattgcaggctgcaacccgcctgcatgaagccggaattgctagtaatcgcggatcagcatgccgcggtgaatacgttcccgggccttgtacacaccgcccgtcacaccatgagagttggcaacacccgaagccgatagtctaaccgcaagggggacgtcgtcgaaggtggggttgatgattggggtgaagtcgtaacaaggtagccgtatcggaaggtgcggctggatcacctccttt

SEQ ID NO: 11 - DNA, 1515 bp, Clostridium_sp.
atgagagtttgatcctggctcaggatgaacgctggcggcgtgcctaacacatgcaagtcgaacggaatttacatgaagcctagcgattgtaaatttagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtaggactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtacgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaaccgaaaggaaggagccgccgaaggcaggtctgataactggggtgaagtcgtaacaaggtagccgtatcggaaggtgcggctggatcacctccttt

SEQ ID NO: 12 - DNA, 1558 bp, Clostridium_sp.
  misc_feature (992)..(1038): n is a, c, g, or t
atgagagtttgatcctggctcaggatgaacgctggcggcgtgcctaacacatgcaagtcgaacgaggtattttgattgaagttttcggatggatttcaagataccgagtggcggacgggtgagtaacgcgtgggtaacctgcctcatacagggggataacggttagaaatgactgctaataccgcataagcgcacagtaccgcatggtacggtgtgaaaaactccggtggtatgagatggacccgcgtctgattagctagttggtggggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaannnnnnnnnnnnnnnnnnnnnnnnnnnnnnnnnnnnnnnnnnnnnnncctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctccttt

SEQ ID NO: 13 - DNA, 1529 bp, Flavonifractor_sp.
tattgagagtttgatcctggctcaggatgaacgctggcggcgtgcttaacacatgcaagtcgaacggagtgctcatgacagaggattcgtccaatggagtgagttacttagtggcggacgggtgagtaacgcgtgagtaacctgccttggagtggggaataacaggtggaaacatctgctaataccgcatgatgcagttgggtcgcatggctctgactgccaaagatttatcgctctgagatggactcgcgtctgattagctggttggcggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttctcagggacgaagcaagtgacggtacctgaggaataagccacggctaactacgtgccagcagccgcggtaatacgtaggtggcgagcgttatccggatttactgggtgtaaagggcgtgtaggcgggactgcaagtcagatgtgaaaaccatgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccggtgaccggtgtagagatacaccttcttcttcggaagcgccggtgacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggtcaacagagggaagcaagaccgcgaggtggagcaaacccctaaaagccatcccagttcggattgcaggctgcaactcgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctccttt

SEQ ID NO: 14 - DNA, 1514 bp, Emergencia_timonensis
attaagagtttgatcctggctcaggatgaacgctggcggcgtgcctaacacatgcaagtcgagcgagaagccattgaccgatacttcggtaaagggatatggcggaaagcggcggacgggtgagtaacgcgtaggcaacctgccccttacagagggatagccattggaaacgatgattaagacctcataacgcctccctcccacatgagggggaggccaaagattcatcggtaagggatgggcctgcgtctgattagcttgttggcggggtaacggcccaccaaggcgacgatcagtagccgacctgagagggtgatcggccacattggaactgagacacggtccaaactcctacgggaggcagcagtggggaatattgcacaatgggcggaagcctgatgcagcaacgccgcgtgagggatgaaggccttcgggtcgtaaacctctgtccttggggaagaaacaaatgacggtacccatggaggaagccccggctaactacgtgccagcagccgcggtaatacgtagggggcgagcgttatccggaattattgggcgtaaagagtgcgtaggtggttacctaagcgcagggtctaaggcaatggctcaaccattgttcgccctgcgaactgggctacttgagtgcaggagaggaaagcggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgagcactaggtgtcggggccgcaaggcttcggtgccgcagttaacgcattaagtgctccgcctggggagtacgcacgcaagtgtgaaactcaaaggaattgacggggacccgcacaagcagcggagcatgtggtttaattcgaagcaacgcgaagaaccttaccaggacttgacatccccctgacagatccttaaccggatccttcttcggacaggggagacaggtggtgcatggttgtcgtcagctcgtgtcgtgagatgttgggttaagtcccgcaacgagcgcaacccttgccattagttgccatcattcagttgggcactctaatgggactgccggggacaactcggaggaaggtggggatgacgtcaaatcatcatgccccttatgttctgggctacacacgtgctacaatggccggtacagcaggaagcgatcccgcgagggggagcaaatcccaaaaaccggtcccagttcggactgcaggctgcaacccgcctgcacgaagccggagttgctagtaatcgtggatcagaatgccacggtgaatgcgttcccgggtcttgtacacaccgcccgtcacaccatggaagttgggggtgcccgaagccggcagggagatatgctgtctaaggcaaaaccaatgactggggtgaagtcgtaacaaggtagccgtatcggaaggtgcggctggatcacctccttt

SEQ ID NO: 15 - DNA, 1527 bp, Clostridium_sp.
atgagagtttgatcctggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggtggtatgagatggacccgcgtctgattagctagttggtgaggtaacggcccaccaaggcaacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaatacccgggctcaacctgggaactgctttggaaactgtatggctagagtgctggagaggtaagcggaattcctagtgtagcggtgaaatgcgtagatattaggaagaacaccagtggcgaaggcggcttactggacagtaactgacgttcaggctcgaaagcgtggggagcaaacaggattagataccctggtagtccacgccgtaaacgatgaatactaggtgtcgggggacaaagtctttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaggcgaagctgtgaggcagagcaaatctcaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctccttt

SEQ ID NO: 16 - DNA, 986 bp, Clostridium_sp.
  misc_feature (1)..(1): n is a, c, g, or t
nccggatttactgggtgtaaagggtgcgtaggcggaactgcaagtcagtggtgaaatctgagggctcaaccctcaaactgccattgaaactgtggttcttgagtgaagtagaggtaggcggaattcccggtgtagcggtggaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccctccgtgccggagttaacacaataagtaatccacctggggagtacggccgcaaggttgaaactcaaaggaattgacgggggcccgcacaagcagtggagtatgtggtttaattcgacgcaacgcgaagaaccttaccaggtcttgacatccaactaacgaggtagagatacgtcaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggatgacgtcaaatcatcatgccctttatgacctgggctacacacgtactacaatggccgtaaacagagagaggcgacaccgcgaggtgaagcgaaaccctaaaaacggtctcagttcggattgtaggctgcaacccgcctacatgaagttggaattgctagtaatcgcggatcagcatgccgcggtgaatacgttcccgggccttgtacacaccgcccgtcacaccatgggagccggtaatacccgaagtcagtagtctaaccgcaaggggggcgctgccgaaggtaggattggcgactggggtgaagtcgtaacaaggtagccgtatcggaaggtgcggctggatcacctccttt

SEQ ID NO: 17 - DNA, 1081 bp, Clostridium_sp.
  misc_feature (660)..(660): n is a, c, g, or t
acggcccagactcctacgggaggcagcagtggggaatattgcgcaatgggggaaaccctgacgcagcaacgccgcgtgattgaagaaggccttcgggttgtaaagatctttaattagggacgaaataaatgacggtacctgaagaataagctccggctaactacgtgccagcagccgcggtaatacgtagggagcaagcgttatccggatttactgggtgtaaagggcgcgcaggcgggccggtaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgncttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaac

SEQ ID NO: 18 - DNA, 1526 bp, Clostridium_sp.
tttagagagtttgatcctggctcaggatgaacgctggcggcgtgcctaacacatgcaagtcgaacggggttattttggaaatctcttcggagatggaattcttaacctagtggcggacgggtgagtaacgcgtgagcaatctgcctttaggagggggataacagtcggaaacggctgctaataccgcataatacgtttgggaggcatctcttgaacgtcaaagattttatcgcctttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaaaatgacggtacctgaagaataagctccggctaactacgtgccagcagccgcggtaatacgtagggagcaagcgttatccggatttactgggtgtaaagggcgcgcaggcgggccggcaagttgggagtgaaatcccggggcttaaccccggaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggcgtagagatacgccctctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaataccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggggggcgcggccgaaggtaggggtggtaattagggtgaagtcgtaacaaggtagccgtatcggaaggtgcggctggatcacctccttt

SEQ ID NO: 19 - DNA, 1529 bp, Flavonifractor_sp.
tattgagagtttgatcctggctcaggatgaacgctggcggcgtgcttaacacatgcaagtcgaacggagtgcccatgacagaggattcgtccaatggattgggttacttagtggcggacgggtgagtaacgcgtgaggaacctgcctcggagtggggaataacacaacgaaagctgtgctaataccgcatgatacagttgggtcgcatgactctgactgtcaaagatttatcgctctgagatggcctcgcgtctgattagctagttggtggggtaacggcccaccaaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttctcagggacgaagcaagtgacggtacctgaggaataagccacggctaactacgtgccagcagccgcggtaatacgtaggtggcaagcgttatccggatttactgggtgtaaagggcgtgtaggcgggatcgcaagtcagatgtgaaaactggaggctcaacctccagcctgcatttgaaactgtggttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccgaggcccggcctagagataggcctttctcttcggagacctcggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaggcaagaccgtgaggtggagcaaatccctaaaagccatcccagttcggattgcaggctgcaacccgcctgcatgaagttggaatcgctagtaatcgcggatcagcatgccgcggtgaatacgttcccgggccttgtacacaccgcccgtcacaccatgagagtcgggaacacccgaagtccgtagcctaacagcaatgggggcgcggccgaaggtgggttcgataattggggtgaagtcgtaacaaggtagccgtatcggaaggtgcggctggatcacctccttt

SEQ ID NO: 20 - DNA, 1529 bp, Intestinimonas_massiliensis
tattgagagtttgatcctggctcaggatgaacgctggcggcgtgcttaacacatgcaagtcgaacggaacgccaaggaaagagttttcggacaatggaattggctgtttagtggcggacgggtgagtaacgcgtgagtaacctgccttggagtggggaataacacagtgaaaactgtgctaataccgcatgacatattggtgtcgcatggcactgatatcaaagatttatcgctctgagatggactcgcgtctgattagatagttggcggggtaacggcccaccaagtcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttaacagggacgaagtaagtgacggtacctgttgaataagccacggctaactacgtgccagcagccgcggtaatacgtaggtggcaagcgttatccggatttactgggtgtaaagggcgtgtaggcgggactgcaagtcagatgtgaaaactatgggctcaacccatagcctgcatttgaaactgtagttcttgagtgtcggagaggcaatcggaattccgtgtgtagcggtgaaatgcgtagatatacggaggaacaccagtggcgaaggcggattgctggacgataactgacgctgaggcgcgaaagcgtggggagcaaacaggattagataccctggtagtccacgccgtaaacgatggatactaggtgtggggggtctgaccccctccgtgccgcagctaacgcaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaaccagagatggattaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggcggttaacagagggaggcaaagccgcgaggcagagcaaacccctaaaagccgtcccagttcggattgcaggctgaaacccgcctgtatgaagtcggaatcgctagtaatcgcggatcagcatgccgcggtgaatacgttcccgggccttgtacacaccgcccgtcacaccatgagagtcgggaacacccgaagtccgtagcctaactgcaaagggggcgcggccgaaggtgggttcgataattggggtgaagtcgtaacaaggtagccgtatcggaaggtgcggctggatcacctccttt

SEQ ID NO: 21 - DNA, 1522 bp, Clostridium_sp.
atggagagtttgatcctggctcaggatgaacgctggcggcgtgcctaatacatgcaagtcgaacgcttcacttcggtgaagagtggcgaacgggtgagtaatacataagtaacctggcatctacagggggataactgatggaaacgtcagctaagaccgcataggtgtagagatcgcatgaactctatatgaaaagtgctacgggactggtagatgatggacttatggcgcattagctggttggtagggtaacggcctaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaagtaattcgttatgtaaacttctgtcatagaggaagaacggtggatatagggaatgatatccaagtgacggtactctataagaaagccacggctaactacgtgccagcagccgcggtaatacgtaggtggcgagcgttatccggaattattgggcgtaaagagggagcaggcggcactaagggtctgtggtgaaagatcgaagcttaacttcggtaagccatggaaaccgtagagctagagtgtgtgagaggatcgtggaattccatgtgtagcggtgaaatgcgtagatatatggaggaacaccagtggcgaaggcgacgatctggcgcataactgacgctcagtcccgaaagcgtggggagcaaataggattagataccctagtagtccacgccgtaaacgatgagtactaagtgttgggtgtcaaagctcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatcgatctaaaggctccagagatggagagatagctatagagaagacaggtggtgcatggttgtcgtcagctcgtgtcgtgagatgttgggttaagtcccgcaacgagcgcaacccctgttgccagttgccagcattaagttggggactctggcgagactgccggtgacaagccggaggaaggcggggatgacgtcaaatcatcatgccccttatgacctgggctacacacgtgctacaatggacagagcagagggaagcgaagccgcgaggtggagcgaaacccataaaactgttctcagttcggactgcagtctgcaactcgactgcacgaagatggaatcgctagtaatcgcgaatcagcatgtcgcggtgaatacgttctcgggccttgtacacaccgcccgtcacaccatgagagtcggtaacacccgaagccggtggcctaaccgcaaggaaggagctgtctaaggtgggactgatgattggggtgaagtcgtaacaaggtatccctacgggaacgtggggatggatcacctccttt

SEQ ID NO: 22 - DNA, 1512 bp, Blautia_faecis
  misc_feature (194)..(194): n is a, c, g, or t
tattgagagtttgatcctggctcaggacgaacgctggcggcatgcctaacacatgcaagtcgagcgagttgatctcttcggagtgaagctagcggcggacgggtgagtaacacgtgggcaacctgcctcatagaggggaatagcctcccgaaagggagattaataccgcataagattgtagcttcgcatgaagnagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaatgccgcgtgagtgatgacggccttcgggttgtaaagctctgtcttcggggacgataatgacggtacccgaggaggaagccacggctaactacgtgccagcagccgcggtaatacgtaggtggcaagcgttgtccggatttactgggcgtaaagggagcgtaggcggatttttaagtgagatgtgaaatacccgggcttaacttgggtgctgcatttcaaactggaagtctagagtgcaggagaggagaagggaattcctagtgtagcggtgaaatgcgtagagattaggaagaacaccagtggcgaaggcgcttctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaatcggggaagtcgcttcggcgacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctaactcgtaagagaggaagcgccctaaggtagggtcagcgattggggtgaagtcgtaacaaggtagccgtaggagaacctgcggctggatcacctccttt

SEQ ID NO: 23 - DNA, 1513 bp, Clostridium_disporicum
agtgagagtttgatcctggctcaggacgaacgctggcggcgtgcctaacacatgcaagtcgagcgagtgaatctccttcgggagtgaagctagcggcggacgggtgagtaacacgtgggcaacctgcctcatagaggggaatagccttccgaaaggaagattaataccgcataagattgtagcttcgcatgaagtagcaattaaaggagcaatccgctatgagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggccttcgggttgtaaagctctgtcttcagggacgataatgacggtacctgaggaggaagccacggctaactacgtgccagcagccgcggtaatacgtaggtggcgagcgttgtccggatttactgggcgtaaagggagcgtaggcggacttttaagtgagatgtgaaatacccgggctcaacttgggtgctgcatttcaaactggaagtctagagtgcaggagaggagaatggaattcctagtgtagcggtgaaatgcgtagagattaggaagaacaccagtggcgaaggcgattctctggactgtaactgacgctgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgcattacccttaatcggggaagttccttcgggaacaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggcaagtacaaagagaagcaagaccgcgaggtggagcaaaactcaaaaacttgtctcagttcggattgtaggctgaaactcgcctacatgaagctggagttgctagtaatcgcgaatcagcatgtcgcggtgaatacgttcccgggccttgtacacaccgcccgtcacaccatgagagttggcaatacccaaagtgcgtgatctgactcgcaagagaggaagcgccctaaggtagggtcagcgattggggtgaagtcgtaacaaggtagccgtaggagaacctgcggctggatcacctccttt

SEQ ID NO: 24 - DNA, 1511 bp, Anaerostipes_sp.
atgagagttcgatcctggctcaggataaacgctggcggcgtgcttaacacatgcaagtcgaacgaagtttttctttcgggaggaacttagtggcggacgggtgagtaacgcgtgggtaacctgccctgtacagggggacaacagctggaaacggctgctaataccgcataagcccttagcactgcatggtgcatagggaaaaggagcaatccggtacaggatggacccgcgtctgattagccagttggcagggtaacggcctaccaaagcgacgatcagtagccgatctgagaggatgtacggccacattgggactgagacacggcccagactcctacgggaggcagcagtggggaatattgcacaatggaggaaactctgatgcagcgacgccgcgtgagtgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtaggtggcaaggcaagccagaagtgaaaacccggggctcaaccgcgggattgcttttggaactgtcatgctagagtgcaggaggggtgagcggaattcctagtgtagcggtgaaatgcgtagatattaggaggaacaccggaggcgaaggcggctcactggactgtaactgacactgaggctcgaaagcgtggggagcaaacaggattagataccctggtagtccacgcggtaaacgatgaatactagatgtcgggtagcaaagctactcggtgtcgtcgcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccattcgatagagggtaatgcctctagcccttcgggggaatggagacaggtggtgcatggttgtcgtcagctcgtgtcgtgagatgttgggttaagtcccgcaacgagcgcaacccttattgtcagtagccagcaggtgaagctgggcactctgatgagactgccggggataacccggaggaaggtggggatgacgtcaaatcatcatgccccttatgagcagggctacacacgtgctacaatggcgtaaacagagggaagcgaaggagtgatccggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggtaatgcccgaagtcagtgactcaaccgaaaggagagagctgccgaaggcaggactggtaactggggtgaagtcgtaacaaggtagccgtatcggaaggtgcggctggatcacctccttt

SEQ ID NO: 25 - DNA, 1513 bp, Ruminococcus_bicirculans
tttagagagtttgatcctggctcaggacgaacgctggcggcgtgcctaacacatgcaagtcgaacggagcttgaggggcttgcccttcaagcttagtggcggacgggtgagtaacgcgtgagtaacctgcctctcagagggggataacgttctgaaaaggacgctaataccgcatgacatcccggggccgcatggccctgggatcaaaggagcaatccgctgagagatggactcgcgtccgattagctagttggtgagataaaggcccaccaaggcgacgatcggtagccggactgagaggttgaacggccacattgggactgagacacggcccagactcctacgggaggcagcagtgggggatattgcacaatggagggaactctgatgcagcaacgccgcgtgagggaagaaggtcttcggattgtaaacctttgtcctcagggaagataatgacggtacctgaggaggaagctccggctaactacgtgccagcagccgcggtaatacgtagggagcaagcgttgtccggatttactgggtgtaaagggtgcgtaggcggaactgcaagtcagtggtgaaatctgagggctcaaccctcaaactgccattgaaactgtggttcttgagtgaagtagaggtaggcggaattcccggtgtagcggtggaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccctccgtgccggagttaacacaataagtaatccacctggggagtacggccgcaaggttgaaactcaaaggaattgacgggggcccgcacaagcagtggagtatgtggtttaattcgacgcaacgcgaagaaccttaccaggtcttgacatccaactaacgaggtagagatacgtcaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggatgacgtcaaatcatcatgccctttatgacctgggctacacacgtactacaatggccgtaaacagagagaggcgacaccgcgaggtgaagcgaaaccctaaaaacggtctcagttcggattgtaggctgcaacccgcctacatgaagttggaattgctagtaatcgcggatcagcatgccgcggtgaatacgttcccgggccttgtacacaccgcccgtcacaccatgggagccggtaatacccgaagtcagtagtctaaccgcaaggggggcgctgccgaaggtaggattggcgactggggtgaagtcgtaacaaggtagccgtatcggaaggtgcggctggatcacctccttt

SEQ ID NO: 26 - DNA, 1511 bp, Ruminococcus_bicirculans
attaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctccttt

SEQ ID NO: 27 - DNA, 1553 bp, Streptococcus gordonii
aatgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaagatgcaactgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctt

SEQ ID NO: 28 - DNA, 1553 bp, Streptococcus gordonii; identical to SEQ ID NO: 27

SEQ ID NO: 29 - DNA, 1553 bp, Streptococcus gordonii; identical to SEQ ID NO: 27

SEQ ID NO: 30 - DNA, 1553 bp, Streptococcus gordonii
aatgagagtttgatcctggctcaggacgaacgctggcggcgtgcctaatacatgcaagtagaacgcacagtttataccgtagcttgctacaccataaactgtgagttgcgaacgggtgagtaacgcgtaggtaacctgcctggtagcgggggataactattggaaacgatagctaataccgcataatattgattattgcatgataattgattgaaagatgctattgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctt

SEQ ID NO: 31 - DNA, 1509 bp, Akkermansia_muciniphila
atggagagtttgattctggctcagaacgaacgctggcggcgtggataagacatgcaagtcgaacgagagaattgctagcttgctaataattctctagtggcgcacgggtgagtaacacgtgagtaacctgcccccgagagcgggatagccctgggaaactgggattaataccgcatagtatcgaaagattaaagcagcaatgcgcttggggatgggctcgcggcctattagttagttggtgaggtaacggctcaccaaggcgatgacgggtagccggtctgagaggatgtccggccacactggaactgagacacggtccagacacctacgggtggcagcagtcgagaatcattcacaatgggggaaaccctgatggtgcgacgccgcgtgggggaatgaaggtcttcggattgtaaacccctgtcatgtgggagcaaattaaaaagatagtaccacaagaggaagagacggctaactctgtgccagcagccgcggtaatacagaggtctcaagcgttgttcggaatcactgggcgtaaagcgtgcgtaggctgtttcgtaagtcgtgtgtgaaaggcgcgggctcaacccgcggacggcacatgatactgcgagactagagtaatggagggggaaccggaattctcggtgtagcagtgaaatgcgtagatatcgagaggaacactcgtggcgaaggcgggttcctggacattaactgacgctgaggcacgaaggccaggggagcgaaagggattagatacccctgtagtcctggcagtaaacggtgcacgcttggtgtgcggggaatcgaccccctgcgtgccggagctaacgcgttaagcgtgccgcctggggagtacggtcgcaagattaaaactcaaagaaattgacggggacccgcacaagcggtggagtatgtggcttaattcgatgcaacgcgaagaaccttacctgggcttgacatgtaatgaacaacatgtgaaagcatgcgactcttcggaggcgttacacaggtgctgcatggccgtcgtcagctcgtgtcgtgagatgtttggttaagtccagcaacgagcgcaacccctgttgccagttaccagcacgtgaaggtggggactctggcgagactgcccagatcaactgggaggaaggtggggacgacgtcaggtcagtatggcccttatgcccagggctgcacacgtactacaatgcccagtacagagggggccgaagccgcgaggcggaggaaatcctaaaaactgggcccagttcggactgtaggctgcaacccgcctacacgaagccggaatcgctagtaatggcgcatcagctacggcgccgtgaatacgttcccgggtcttgtacacaccgcccgtcacatcatggaagccggtcgcacccgaagtatctgaagccaaccgcaaggaggcagggtcctaaggtgagactggtaactgggatgaagtcgtaacaaggtagccgtaggggaacctgcggctggatcacctccttt

SEQ ID NO: 32 - DNA, 1509 bp, Akkermansia_muciniphila; identical to SEQ ID NO: 31

SEQ ID NO: 33 - DNA, 1509 bp, Akkermansia_muciniphila; identical to SEQ ID NO: 31

SEQ ID NO: 34 - DNA, 1529 bp, Eubacterium rectale
atgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacggcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggttcggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctccttt

SEQ ID NO: 35 - DNA, 1529 bp, Eubacterium rectale
atgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtccggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctccttt

SEQ ID NO: 36 - DNA, 1529 bp, Eubacterium rectale
atgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacggcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccgcgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtttggccgggcactctagagagactgccagggataacctggaggaaggcggggatgacgtcaaatcatcatgccccttatgacttgggctacacacgtgctacaatggcgtaaacaaagggaagcaaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctccttt

SEQ ID NO: 37 - DNA, 1529 bp, Eubacterium rectale; identical to SEQ ID NO: 34

SEQ ID NO: 38 - DNA, 1529 bp, Eubacterium rectale
atgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgctgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggtctggccgggcactctagagagactgccagggataacctggaggaaggcggggatgacgtcaaatcatcatgccccttatgacttgggctacacacgtgctacaatggcgtaaacaaagggaagcgaagctgtgaagccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttgggaatgcccgaagccagtgacctaaccgaaaggaaggagctgtcgaaggcaggctcgataactggggtgaagtcgtaacaaggtagccgtatcggaaggtgcggctggatcacctccttt

SEQ ID NO: 39 - DNA, 1506 bp, Eggerthella_lenta
acggagagtttgatcctggctcaggatgaacgctggcggcgtgcctaacacatgcaagtcgaacgatgaaaccgccctcgggcggacatgaagtggcgaacgggtgagtaacacgtgaccaacctgccccttgctccgggacaaccttgggaaaccgaggctaataccggatactcctcgcccccctcctggggggcccgggaaagcccagacggcaagggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggaaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttaattcgaagcaacgcgaagaaccttaccagggcttgacatggacgtgaagccggggaaacccggtggccgagaggagcgtccgcaggtggtgcatggctgtcgtcagctcgtgtcgtgagatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacctccttt

SEQ ID NO: 40 - DNA, 1506 bp, Eggerthella_lenta; identical to SEQ ID NO: 39

SEQ ID NO: 41 - DNA, 1506 bp, Eggerthella_lenta; identical to SEQ ID NO: 39

SEQ ID NO: 42 - DNA, 1535 bp, Burkholderiales_bacterium_1_1_47
atagagtttgatcctggctcagattgaacgctggcggaacgctttacacatgcaagtcgaacggtaacgcgggagaagcttgcttctcccggcgacgagtggcgaacgggtgagtaatacatcggaacgtgtccgctcgtgggggacaaccagccgaaaggttggctaataccgcatgagttctacggaagaaagagggggacccgcaagggcctctcgcgagcggagcggccgatgactgattagccggttggtgaggtaacggctcaccaaagcaacgatcagtagctggtctgagaggacgaccagccacactgggactgagacacggcccagactcctacgggaggcagcagtggggaattttggacaatgggcgcaagcctgatccagctattccgcgtgtgggatgaaggccctcgggttgtaaaccacttttgtagagaacgaaaagacaccttcgaataaagggtgttgctgacggtactctaagaataagcaccggctaactacgtgccagcagccgcggtaatacgtagggtgcgagcgttaatcggaattactgggcgtaaagggtgcgcaggcggttgagtaagacagatgtgaaatccccgagcttaactcgggaatggcatatgtgactgctcgactagagtgtgtcagagggaggtggaattccacgtgtagcagtgaaatgcgtagatatgtggaagaacaccgatggcgaaggcagcctcctgggacataactgacgctcaggcacgaaagcgtggggagcaaacaggattagataccctggtagtccacgccctaaacgatgttaactagttgttgggaagtaaaattctcagtaacgcagccaacgcgagaagttaaccgcctgggaagtacggtcgcaagactaaaactcaaaggaattgacggggacccgcacaagcggtggatgatgtggattaattcgatgcaacgcgaaaaaccttacctacccttgacatgtcaggaagctcttgtaatgagagtgtgcccgcaagggagcctgaacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatgggtagggcttcacacgtcatacaatggtcggaacagagggcagcgaagtcgtgagacggagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcaaacaatgggagtggtgtttaccagaagtcgttagcctaaccgcaaggagggcggcgaccacggtgagcaccgtgactaatgttaagtcgtaacaaggtagccgtaccggaaggtgcggctggatcacctccttt

SEQ ID NO: 43 - DNA, 1529 bp, Eubacterium eligens
ttatgagagtttgatcctggctcaggatgaacgctggcggcgtgcttaacacatgcaagtcgaacgaagcatttagaacagattacttcggtttgaagttctttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgaccggtcagtaatgtggcctttccttcgggacaagagagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctccttt

SEQ ID NO: 44 - DNA, 1530 bp, Eubacterium eligens
ttatgagagtttgatcctggctcaggatgaacgctggcggcgtgcttaacacatgcaagtcgaacgaagcatttagaacagattatttcggtatgaagttctttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccaaaagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaaccttaccaagtcttgacatcccactgaccggacagtaatgtgtcctttccttcgggacagtggtgacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctccttt

SEQ ID NO: 45 - DNA, 1529 bp, Eubacterium eligens
ttatgagagtttgatcctggctcaggatgaacgctggcggcgtgcttaacacatgcaagtcgaacgaagcatttagaacagattatttcggtatgaagttctttatgactgagtggcggacgggtgagtaacgcgtgggtaacctgccttgtactgggggatagcagctggaaacggctggtaataccgcataagcgcacaatgttgcatgacatagtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggcttaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggtgacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgaaagaaggagccgccgaaggcaggtttgataactggggtgaagtcgtaacaaggtagccgtatcggaaggtgcggctggatcacctccttt

SEQ ID NO: 46 - DNA, 1529 bp, Eubacterium eligens
ttatgagagtttgatcctggctcaggatgaacgctggcggcgtgcttaacacatgcaagtcgaacgaagcatttagaacagattatttcggtatgaagttctttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtgaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcaaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgcaagaaggagccgccgaaggcaggtttgataactggggtgaagtcgtaacaaggtagccgtatcggaaggtgcggctggatcacctccttt

SEQ ID NO: 47 - DNA, 1529 bp, Eubacterium eligens
ttatgagagtttgatcctggctcaggatgaacgctggcggcgtgcttaacacatgcaagtcgaacgaagcatttgcgacagattttttcggaatgaagttgcttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggagacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctccttt

SEQ ID NO: 48 - DNA, 1531 bp, Eubacterium ventriosum
aacgagagtttgatcctggctcaggatgaacgctggcggcgtgcttaatacatgcaagtcgaacgaagcaccttggacagaatccttcgggaggaagaccattgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctggttggtgaggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggaagaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactaggtgtcgggggacaatagttcctcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccactgacaggtcagtaatgtgaccctttcttcggaacagtggagacaggtggtgcatggttgtcgtcagctcgtgtcgtgagatgttgggttaagtcccgcaacgagcgcaacccttgtctttagtagccagcagtacggctgggcactctagagagactgccagggataacctggaggaaggcggggatgacgtcaaatcatcatgccccttacgagcagggctacacacgtgctacaatggcgtaaacaaagggaagcgaccccgtgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggatatgcccgaagtcagtgacccaaccgtaaggagggagctgccgaaggtggagccgataactggggtgaagtcgtaacaaggtagccgtatcggaaggtgcggctggatcacctccttt

SEQ ID NO: 49 - DNA, 1527 bp, Ruminococcus obeum
tcagagagtttgatcctggctcaggatgaacgctggcggcgtgcttaacacatgcaagtcgaacgggaaacttttcattgaagcttcggcagatttggtctgtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgttccttaaccggaactttccttcgggacagaggagacaggtggtgcatggttgtcgtcagctcgtgtcgtgagatgttgggttaagtcccgcaacgagcgcaacccctatccccagtagccagcggttcggccgggcactctgaggagactgccagggataacctggaggaaggcggggatgacgtcaaatcatcatgccccttatgatttgggctacacacgtgctacaatggcgtaaacaaagggaagcgagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 50 - DNA, 1527 bp, Ruminococcus obeum
tcagagagtttgatcctggctcaggatgaacgctggcggcgtgcttaacacatgcaagtcgaacgggaaacttttcattgaagcttcggcagatttggtctgtttctagtggcggacgggtgagtaacgcgtgggtaacctgccttatacagggggataacaaccagaaatggttgctaataccgcataagcgcacaggaccgcatggtctagtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgttccttaaccggaactttccttcgggacaggggagacaggtggtgcatggttgtcgtcagctcgtgtcgtgagatgttgggttaagtcccgcaacgagcgcaacccctatccccagtagccagcagtccggctgggcactctgaggagactgccagggataacctggaggaaggcggggatgacgtcaaatcatcatgccccttatgatttgggctacacacgtgctacaatggcgtaaacaaagggaagcaagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 51 - DNA, 1100 bp, Ruminococcus obeum
gacacggcccagactcctacgggaggcagcagtggggaatattgtacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacaggggagacaggtggtgcatggttgtcgtcagctcgtgtcgtgagatgttgggttaagtcccgcaacgagcgcaacccctatccccagtagccagcagtccggctgggcactctgaggagactgccagggataacctggaggaaggcggggatgacgtcaaatcatcatgccccttatgatttgggctacacacgtgctacaatggcgtaaacaaagggaagcaagcctgcgaaggtaagcaaatccccaaaaataacgatcccagttcggactgctgtctgcaactcgactgcacgaagctggaattcgctagtaatcgcggatcaaatgccgcggtgaatacgttcccgggatctgtacacacccgcccgtccatccttgggagtctgtacccccgatttagtggacctacc

SEQ ID NO: 52 - DNA, 984 bp, Ruminococcus obeum
tcagagagtttgatcctggctcaggatgaacgctggcggcgtgcttaacacatgcaagtcgaacgggaaacttttcattgaagcttcggcagatttggtctgtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggatttgacgggggacccgcacagcggtggagcatgtggtttattcgagcacggcgaagaaccttaccaagtctgacatcccct

SEQ ID NO: 53 - DNA, 939 bp, Ruminococcus obeum
tcagagagtttgatcctggctcaggatgaacgctggcggcgtgcttaacacatgcaagtcgaacgggaaaccttttattgaagcttcggcagatttagctggtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaagcggcttactggacggtaactgacgttgaggctcgaaagcgtggggagcaaacaggattagatacctggtagtccacgccgtaaacgatgaatactagtgttgggggagcaaagctcttcgtgccgccgcaaacgcattagtattccacctggggagtacgttcgcaagaatgaaactcaaaggaattgaccggcacccacaaacgcgtgagtcagggtgttaa

SEQ ID NO: 54 - DNA, 1529 bp, Ruminococcus torques
aacgagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtggccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactgggggtgaagtcgtaacaaggtagccgtatcggaaggtgcggctggatcacctccttt

SEQ ID NO: 55 - DNA, 1529 bp, Ruminococcus torques
aacgagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtccccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctccttt

SEQ ID NO: 56 - DNA, 1056 bp, Ruminococcus torques
aacgagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtgggagcatgtggtttaattcgaagcaacgcgaagaaccttacctgctcttgacatcccgctgaccggacggtaatgcgtccttcccttcgggcagcggagacaggtggtgcatggttgtcgtcagct

SEQ ID NO: 57 - DNA, 1529 bp, Ruminococcus torques; identical to SEQ ID NO: 54

SEQ ID NO: 58 - DNA, 1177 bp, Ruminococcus torques
aacgagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctggttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctgggggagtacgttcgcaagaatgaaactcaaaggaattgacgggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcacgagcgcaaccctatctttagtagcagcggccaggccgggcactctaaaagagactgccggggataatcccgggaggaaggtggggat

SEQ ID NO: 59 - DNA, 1528 bp, Ruminococcus torques
tacgagagtttgatcctggctcaggatgaacgcgggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtggccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctccttt

SEQ ID NO: 60 - DNA, 1529 bp, Dorea_longicatena
aacgagagtttgatcctggctcaggatgaacgctggcggcgtgcttaacacatgcaagtcgagcgaagcgcttaagtttgattcttcggatgaagacttttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 61 - DNA, 825 bp, Dorea_longicatena
aacgagagtttgatcctggctcaggatgaacgctggcggcgtgcttaacacatgcaagtcgagcgaagcgctttggaaagattcttcggatgatttcctttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaagcggcttgctggacgatgactgacgttgaggctcgaaagcgtggggagcaaacaggattagataccctggtagtccacgccgtaaacgatgactgctaggtgtcgggtgg

SEQ ID NO: 62 - DNA, 1530 bp, Anaerostipes_caccae
atgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcattacggatgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 63 - DNA, 857 bp, Anaerostipes_caccae
ctagcggtgaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgagcgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 64 - DNA, 1442 bp, Anaerostipes_caccae
  misc_feature (1442)..(1442): n is a, c, g, or t
atgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaan

SEQ ID NO: 65 - DNA, 1530 bp, Anaerostipes_caccae
atgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacagggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgaccgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 66 - DNA, 1531 bp, Anaerostipes_caccae
atgagagtttgatcctggctcaggatgaacgctggcggcgtgcttaacacatgcaagtcgaacgaagcatttaggattgaagttttcggatggatttcctatatgactgagtggcggacgggtgagtaacgcgtggggaacctgccctatacaggggggataacagctggaaacggctgctaataccgcataagcgcacagaatcgcatgattcagtgtgaaaagccctggcagtataggatggtcccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaacagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccaatgagcgaaccttaaccggttttttctttcgagacattggagacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 67 - DNA, 1505 bp, Eubacterium siraeum
caaagagtttgatcctggctcaggacgaacgctggcggcgcgcctaacacatgcaagtcgaacggtgaagaggagcttgctcctcggatcagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccaggtcttgacatcgagtgaccgcctaagagattaggctttcccttcggggacacaaagacaggtggtgcatggttgtcgtcagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgccgccgaaggtggggttgatgattagggttaagtcgtaacaaggtagccgtatcggaaggtgcggctggatcacctccttt

SEQ ID NO: 68 - DNA, 1505 bp, Eubacterium siraeum
caaagagtttgatcctggctcaggacgaacgctggcggcgcgcctaacacatgcaagtcgaacggtgaagaggagcttgctcctcggaacagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccaggtcttgacatcgagtgaccgcctaagagattaggctttcccttcggggacacaaagacaggtggtgcatggttgtcgtcagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgccgccgaaggtggggttgatgattagggttaagtcgtaacaaggtagccgtatcggaaggtgcggctggatcacctccttt

SEQ ID NO: 69 - DNA, 1505 bp, Eubacterium siraeum
caaagagtttgatcctggctcaggacgaacgctggcggcgcgcctaacacatgcaagtcgaacggtgaagaggagcttgctcctcggatcagtggcggacgggtgagtaacacgtgagcaacctggctctaagagggggacaacagttggaaacgactgctaataccgcatgatgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccaggtcttgacatcgagtgaccgcctaagagattaggctttcccttcggggacacaaagacaggtggtgcatggttgtcgtcagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgccgccgaaggtggggttgatgattagggttaagtcgtaacaaggtagccgtatcggaaggtgcggctggatcacctccttt

SEQ ID NO: 70 - DNA, 1505 bp, Eubacterium siraeum
caaagagtttgatcctggctcaggacgaacgctggcggcgcgcctaacacatgcaagtcgaacggtgaagaggagcttgctcctcggatcagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccaggtcttgacatcgagtgaccgcctaagagattaggccttcccttcggggacacaaagacaggtggtgcatggttgtcgtcagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgccgccgaaggtggggttgatgattagggttaagtcgtaacaaggtagccgtatcggaaggtgcggctggatcacctccttt

SEQ ID NO: 71 - DNA, 1548 bp, Clostridium leptum
tttagagagtttgatcctggctcaggacgaacgctggcggcgtgcctaacacatgcaagtcgaacggagttaaattcgacacccgagtatccggccgggaggcggggtgctgggggttggatttaacttagtggcggacgggtgagtaacgcgtgagtaacctgcctttcagagggggataacgttctgaaaagaacgctaataccgcataacatcaatttatcgcatgataggttgatcaaaggagcaatccgctggaagatggactcgcgtccgattagccagttggcggggtaacggcccaccaaagcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgttcttagtgacgataatgacggtagctaaggagaaagctccggctaactacgtgccagcagccgcggtaatacgtagggagcgagcgttgtccggatttactgggtgtaaagggtgcgtaggcggcgaggcaagtcaggcgtgaaatctatgggcttaacccataaactgcgcttgaaactgtcttgcttgagtgaagtagaggtaggcggaattcccggtgtagcggtgaaatgcgtagagatcgggaggaacaccagtggcgaaggcggcctactgggctttaactgacgctgaagcacgaaagcatgggtagcaaacaggattagataccctggtagtccatgccgtaaacgatgattactaggtgtggggggtctgaccccctccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgtctaacgaagcagagatgcattaggtgcccttcggggaaaggcgagacaggtggtgcatggttgtcgtcagctcgtgtcgtgagatgttgggttaagtcccgcaacgagcgcaacccttgtttctagttgctacgcaagagcactctagagagactgccgttgacaaaacggaggaaggtggggacgacgtcaaatcatcatgccccttatgacctgggccacacacgtactacaatggctgtaaacagagggaagcaaagccgcgaggtggagcaaaaccctaaaagcagtcccagttcggatcgcaggctgcaacccgcctgcgtgaagtcggaattgctagtaatcgcggatcagcatgccgcggtgaatacgttcccgggccttgtacacaccgcccgtcacaccatgggagccggtaatacccgaagccagtagttcaaccgcaaggagagcgctgtcgaaggtaggattggcgactggggtgaagtcgtaacaaggtagccgtatcggaaggtgcggctggatcacctccttt

SEQ ID NO: 72 - DNA, 1548 bp, Clostridium leptum; identical to SEQ ID NO: 71

SEQ ID NO: 73 - DNA, 1528 bp, Clostridium_bolteae
atgagagtttgatcctggctcaggatgaacgctggcggcgtgcctaacacatgcaagtcgaacgaagcaattgaaggaagttttcggatggaattcgattgactgagtggcggacgggtgagtaacgcgtggataacctgcctcacactgggggataacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 74 - DNA, 1509 bp, Faecalibacterium_prausnitzii
tataaagagtttgatcctggctcaggacgaacgctggcggcgcgcctaacacatgcaagtcgaacgagcgagagagagcttgctttcttgagcgagtggcgaacgggtgagtaacgcgtgaggaacctgcctcaaagagggggacaacagttggaaacgactgctaataccgcataagcccacggctcggcatcgagcagagggaaaaggagcaatccgctttgagatggcctcgcgtccgattagctggttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacactgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcccttgacgatgctggaaacagtatttctcttcggagcaaggagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 75 - DNA, 1509 bp, Faecalibacterium_prausnitzii
tataaagagtttgatcctggctcaggacgaacgctggcggcgcgcctaacacatgcaagtcgaacgagcgagaggaggtttactttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctagttggtgaggtaatggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacactgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgcacatagaaatatgtgtttccttcgggacgcagagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 76 - DNA, 1509 bp, Faecalibacterium_prausnitzii
tataaagagtttgatcctggctcaggacgaacgctggcggcgcgcctaacacatgcaagtcgaacgagcgagagagagcttgctttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcccttgacgatgctggaaacagtatttctcttcggagcaaggagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 77 - DNA, 1509 bp, Faecalibacterium_prausnitzii
tataaagagtttgatcctggctcaggacgaacgctggcggcgcgcctaacacatgcaagtcgaacgagcgagagagagcttgctttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctggttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacaccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgcacatagaaatatgtgtttccttcgggacgcagagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 78 - DNA, 1509 bp, Faecalibacterium_prausnitzii
tataaagagtttgatcctggctcaggacgaacgctggcggcgcgcctaacacatgcaagtcgaacgagcgagagagagcttgctttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctagttggtgaggtaacggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattactgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacactgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgcacatagaaatatgtgtttccttcgggacgcagagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 79 - DNA, 1509 bp, Faecalibacterium_prausnitzii
tataaagagtttgatcctggctcaggacgaacgctggcggcgcgcctaacacatgcaagtcgaacgagcgagagagagcttgctttctcaagcgagtggcgaacgggtgagtaacgcgtgaggaacctgcctcaaagagggggacaacagttggaaacgactgctaataccgcataagcccacgacccggcatcgggtagagggaaaaggagcaatccgctttgagatggcctcgcgtccgattagctagttggtgaggtaatggcccaccaaggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgttgttgaggaagataatgacggtactcaacaaggaagtgacggctaactacgtgccagcagccgcggtaaaacgtaggtcacaagcgttgtccggaattattgggtgtaaagggagcgcaggcgggaagacaagttggaagtgaaatccatgggctcaacccatgaactgctttcaaaactgtttttcttgagtagtgcagaggtaggcggaattcccggtgtagcggtggaatgcgtagatatcgggaggaacaccagtggcgaaggcggcctactgggcaccaactgacgctgaggctcgaaagtgtgggtagcaaacaggattagataccctggtagtccacactgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgacgcaacgcgaagaaccttaccaagtcttgacatcctgcgacgcacatagaaatatgtgtttccttcgggacgcagagacaggtggtgcatggttgtcgtcagctcgtgtcgtgagatgttgggttaagtcccgcaacgagcgcaacccttatggtcagttactacgcaagaggactctggccagactgccgttgacaaaacggaggaaggtggggatgacgtcaaatcatcatgccctttatgacttgggctacacacgtactacaatggcgttaaacaaagagaagcaagaccgcgaggtggagcaaaactcagaaacaacgtcccagttcggactgcaggctgcaactcgcctgcacgaagtcggaattgctagtaatcgcagatcagcatgctgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtaggagaacctgcggctggatcacctccttt

SEQ ID NO: 80 - DNA, 1501 bp, Clostridium_bartlettii
atttgagagtttgatcctggctcaggatgaacgctggcggcgtgcctaacacatgcaagtcgagcgattctcttcggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctccttt

SEQ ID NO: 81 - DNA, 1501 bp, Clostridium_bartlettii
atttgagagtttgatcctggctcaggatgaacgctggcggcgtgcctaacacatgcaagtcgagcgattctctttggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactgggggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctccttt

SEQ ID NO: 82 - DNA, 1169 bp, Clostridium_bartlettii
gaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctccttt

SEQ ID NO: 83 - DNA, 1501 bp, Clostridium_bartlettii
atttgagagtttgatcctggctcaggatgaacgctggcggcgtgcctaacacatgcaagtcgagcgatcttcttcggaagagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctccttt

SEQ ID NO: 84 - DNA, 905 bp, Clostridium_bartlettii
atgcagtcgagcgatcttcttcggagagagcggcggacgggggagtaacgcgtgggtaacctgccctgtacacacggattacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattaaataccctggtattccacgccgtaaacgatgagtactagctgtcggaggttaccccctttcggtggcgcagctaacgcataaatactcgcctggggagtacgctcgctagagtgaaattaacagaattgactggatcctgcccaattagcggaacatgtgcttgactcgtaccaacggaaaaaccttagcattcctgcttccttgacgtg

SEQ ID NO: 85 - DNA, 1501 bp, Clostridium_bartlettii
atttgagagtttgatcctggctcaggatgaacgctggcggcgtgcctaacacatgcaagtcgagcgattctcttcggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctccttt

SEQ ID NO: 86 - DNA, 1524 bp, Clostridium ramosum
atggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctccttt

SEQ ID NO: 87 - DNA, 1026 bp, Clostridium scindens
cagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattttggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttt

SEQ ID NO: 88 - DNA, 1532 bp, Clostridium scindens
aacgagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattttggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagttggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttt

SEQ ID NO: 89 - DNA, 1521 bp, Anaerotruncus_colihominis
caaagagtttgatcctggctcaggacgaacgctggcggcgcgcctaacacatgcaagtcgaacggagcttacgttttgaagttttcggatggatgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccgcaaggggggcgctgtcgaaggtgggattgatgactggggtgaagtcgtaacaaggtagccgtatcggaaggtgcggctggatcacctccttt

SEQ ID NO: 90 - DNA, 1521 bp, Anaerotruncus_colihominis
caaagagtttgatcctggctcaggacgaacgctggcggcgcgcctaacacatgcaagtcgaacggagcttacgttttgaagttttcggatggacgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcatagcctagagataggtgaagcccttcggggcatccagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggcggcgacaccgcgaggtgaagcgaatcccgaaaaagtgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagccagtagcctaaccgcaaggggggcgctgtcgaaggtgggattgatgactggggtgaagtcgtaacaaggtagccgtatcggaaggtgcggctggatcacctccttt

SEQ ID NO: 91 - DNA, 1023 bp, Anaerotruncus_colihominis
tcaaagagtttgatcctggctcaggacgaacgctggcggcgcgcctaacacatgcaagtcgaacggagcttacgttttgaagttttcggatggatgaatgtaagcttagtggcggacgggtgagtaacacgtgagcaacctgcctttcagagggggataacagccggaaacggctgctaataccgcatgatgttgcgggggcacatgcccctgcaaccaaaggagcaatccgctgaaagatgggctcgcgtccgattagccagttggcggggtaacggcccaccaaagcgacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaaaatgacggtacccaaagaggaagctccggctaactacgtgccagcagccgcggtaatacgtagggagcaagcgttgtccggaattactgggtgtaaagggagcgtaggcgggatggcaagtagaatgttaaatccatcggctcaaccggtggctgcgttctaaactgccgttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaacgatgattactaggtgtggggggactgaccccttccgtgccgcagttaacacataagtaatccacctggggagtacggccgcaggtgaactcaaggattgacggggcccgcacagcagtgagtatgtggtttatcgagcacgcgagactacagtctgacatcgatgcatagctagagatagtgagccctcgggcatccagacaggtgggtgcatgggtgtcg

SEQ ID NO: 92 - DNA, 1521 bp, Anaerotruncus_colihominis; identical to SEQ ID NO: 89

SEQ ID NO: 93 - DNA, 1304 bp, Clostridium spiroforme
atggagagtttgatcctggctcaggatgaacgctggcggcgtgcctaatacatgcaagtcgaacgcgagcagcaatgctcgagtggcgaacgggtgagtaatacataagtaacctgccctagacagggggataactgctggaaacggcagctaagaccgcataggtatggacactgcatggtgaccatattaaaagtgccaaggcactggtagaggatggacttatggcgcattagctggttggtgaggtaacagctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctgtggtgaaagactgaagcttaacttcagtaagccatagaaaccgggctgctagagtgcaggagaggatcgtggaattccatgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatccggataaagacctcagagatgaggggatagatatatccgagacaggtggtgcatggttgtcgtcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctggctacacacgtgctacaatgatggagcagagggaagcgaagccgcgagtgagcaaacccataaaccattctcagtcggattgtagtctgcactcgactacatga

SEQ ID NO: 94 - DNA, 886 bp, Clostridium spiroforme
atggagagtttgatcctggctcaggatgaacgctggcggcgtgcctaatacatgcaagtcgaacgcgagcagcaatgctcgagtggcgaacgggtgagtaatacataagtaacctgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctatggtgaaagactgaagcttaacttcagtaagccatagaaaccgggctgctagagtgcaggagaggatcgtgaattccatgtgtagcggtgaaatgcgtagatatatggaggaacaccagtggcgaaggcgacggtctgcctgtaactgacgctcattcccgaaagcgtggggagcaaataggattagataccctagtagtccacgccgtaacgatgagtactaagtgtgggagtcaaatttcagtgctgcagttaacgcaataagtacctccgccttgaatagtacgttcgcaaga

SEQ ID NO: 95 - DNA, 1390 bp, Clostridium spiroforme
atggagagtttgatcctggctcaggatgaacgctggcggcgtgcctaatacatgcaagtcgaacgcgagcagcaatgctcgagtggcgaacgggtgagtaatacataagtaacccgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctatggtgaaagactgaagcttaacttcagtaagccatagaaaccgggctgctagagtgcaggagaggatcgtggaattccatgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatccggataaagacctcagagatgaggggatagatatatccgagacaggtggtgcatggttgtcgtcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctgcgctacacacgtgctacaatgtatggagcagagggaagcgaagccgcgaggtgaagcaaacccataaaccattctcagttcggattgtagtctgcaactcgactacatgagtgtatcgctagtatcgcgatcagcatgtcgcgtgaatacgttctcggccttgtacacaccccgcccgtcaacaccattg

SEQ ID NO: 96 - DNA, 1517 bp, Anaerofustis_stercorihominis
ttttgagagtttgatcctggctcaggacgaacgctggcggcgtgcttaacacatgcaagtcgaacgagaaacttataaatgatccttcgggtgaatctataagcggacagtggcgaacgggtgagtaacgcgtaggtaaccaacctcatgcagggggatagcccagggaaacttggattaaacccgcataagaccacagcaccgcatggtgcaggggtaaaaactccggtggcatgagacggacctgcgtcttattaggtagttggtgaggtaacggctcaccaagccaacgatgagtagccgacctgagagggtgatcggccacattgggactgagacacggcccagactcctacgggaggcagcagtggggaatattgcgcaatgggggaaaccctgacgcagcaacgccgcgtgagcgatgaaggttttcggatcgtaaagctctgtctttggggaagataatgacggtacccaaggaggaagctccggctaactacgtgccagcagccgcggtaatacgtagggagcaagcgttgtccggattcactgggcgtaaagagcacgtaggcggttaattaagtcaggtgtgaaagttttcggctcaaccggaaaagtgcacttgaaactggataacttgagtatcggagaggtaagcggaattcctagtgtagcggtgaaatgcgtagagattaggaagaacaccggtggcgaaggcggcttactggacgataactgacgctgaggtgcgaaagcgtggggagcgaacaggattagataccctggtagtccacgccgtaaacgatgaatactaggtgttggggtaactcagtgccgcagttaacacattaagtattccgcctggggagtacgctcgcaagagtgaaactcaaaggaattgacgggggcccgcacaagcagcggagcatgtggtttaattcgaagcaacgcgaagaaccttaccaggtcttgacatcccttgaccgcctaagagattaggctttccttcgggacaaggagacaggtggtgcatggttgtcgtcagctcgtgtcgtgagatgttgggttaagtcccgcaacgagcgcaacccttatgtttagttactaacattcagttgaggactctagacagactgcccttgaaagagggaggaaggtggggacgacgtcaaatcatcatgccccttacgacctgggctacacacgtgctacaatggtctgtacagagggttgcgaagcagtgatgctaagctaatctcaaaaagcagatctcagttcggattgcaggctgcaactcgcctgcatgaagtcggagttgctagtaatcgcgaatcagaatgtcgcggtgaatgcgttcccgggccttgtacacaccgcccgtcacaccacgagagttggtaacacccgaagccagtgagctaaccattaggaggcagctgtcgaaggtgggatcagtaattggggtgaagtcgtaacaaggtagccgtatcggaaggtgcggctggatcacctccttt

SEQ ID NO: 97 - DNA, 1517 bp, Anaerofustis_stercorihominis; identical to SEQ ID NO: 96

SEQ ID NO: 98 - DNA, 1527 bp, Clostridiales_bacterium_1_7_47FAA
tttgagagtttgatcctggctcaggatgaacgctggcggcgtgcctaacacatgcaagtcgaacgaagcatcttataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggggagacaggtggtgcatggttgtcgtcagctcgtgtcgtgagatgttgggttaagtcccgcaacgagcgcaacccttatccttagtagccagcatttcgggtgggcactctagggagactgccagggataacctggaggaaggtggggatgacgtcaaatcatcatgccccttatgatttgggctacacacgtgctacaatggcgtaaacaaagggaagcaccctgcgaaggtgagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctccttt

SEQ ID NO: 99 - DNA, 1528 bp, Coprococcus_comes
aacgagagtttgatcctggctcaggatgaacgctggcggcgtgcttaacacatgcaagtcgaacgaagcactttaacctgattcttcggatgaaggtttttgtgactgagtggcggacgggtgagtaacgcgtgggtaacctgcctcatacagggggataacagttagaaatgactgctaataccgcataagaccacagagccgcatggctcggtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 100 - DNA, 1076 bp, Roseburia_intestinalis
atgagagtttgatcctggctcaggatgaacgctggcggcgtgcttaacacatgcaagtcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagtattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacagaacatgtaatgtgttttctcttcggagcatcggtgacaggtggtgcatggttgtcgtcagctcgtgtcgtgagatgttggg

SEQ ID NO: 101 - DNA, 1530 bp, Blautia_hydrogenotrophica
cagagagtttgatcctggctcaggatgaacgctggcggcgtgcttaacacatgcaagtcgaacgaagcgatagagaacggagatttcggttgaagttttctattgactgagtggcggacgggtgagtaacgcgtgggtaacctgccctatacagggggataacagttagaaatgactgctaataccgcataagcgcacagcttcgcatgaagcggtgtgaaaaactgaggtggtataggatggacccgcgttggattagctagttggtgaggtaacggcccaccaaggcgacgatccatagccggcctgagagggtgaacggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagaaagtgacggtacctgactaagaagccccggctaattacgtgccagcagccgcggtaatacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcctgctggacggtaactgacgttgaggctcgaaagcgtggggagcaaacaggattagataccctggtagtccacgctgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggaagtaatgttcccttttcttcggaacagaggagacaggtggtgcatggttgtcgtcagctcgtgtcgtgagatgttgggttaagtcccgcaacgagcgcaacccttattcttagtagccagcaggtagagctgggcactctagggagactgccagggataacctggaggaaggtggggatgacgtcaaatcatcatgccccttatgatttgggctacacacgtgctacaatggcgtaaacaaagggaagcgaaggggtgacctggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgaaaggagggagctgccgaaggtgggactgataactggggtgaagtcgtaacaaggtagccgtatcggaaggtgcggctggatcacctccttt

SEQ ID NO: 102 - DNA, 1264 bp, Holdemania_filiformis
acctaggcgatgatacgtagccgacctgagagggtgaccggccacattgggactgagacacggcccaaactcctacgggaggcagcagtagggaattttcggcaatgggcgaaagcctgaccgagcaacgccgcgtgagtgaagaaggccttcgggttgtaaagctctgttgtgaaggaagaacggctcatacagggaatggtatgggagtgacggtactttaccagaaagccacggctaactacgtgccagcagccgcggtaatacgtaggtggcgagcgttatccggaattattgggcgtaaagggtgcgcaggcggtttgttaagtttaaggtgaaagcgtggggcttaaccccatatagccttagaaactgacagactagagtacaggagagggcaatggaattccatgtgtagcggtaaaatgcgtagatatatggaggaacaccagtggcgaaggcggttgcctggcctgtaactgacgctcatgcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcaacgcgaagaaccttaccaggtcttgacatcccctgcaaagacatagagatatgttggaggttatcagggagacaggtggtgcatggttgtcgtcagctcgtgtcgtgagatgttgggttaagtcccgcaacgagcgcaacccttgtctttagttgctaacattaagttgaggactctagagagactgccggtgacaaaccggaggaaggtggggatgacgtcaaatcatcatgccccttatgacctgggctacacacgtactacaatggcggatacaacgagaagcaagacagtgatgtggagcaaaactcagaaagtccgtctcagttcggattgaagtctgcaacccgacttcatgaagccggaatcgctagtaatcgcggatcagcatgccgcggtgaatacgttctcgggccttgtacacaccgcccgtcaaaccatgagagttggcaatacccgaagccggtggcctaacctcgcaagaggagggagccgtcgaaggtagggctgatgattggggttaagtcgtaacaaggtatccctacgggaacgtggggatggatcacctccttt

SEQ ID NO: 103 - DNA, 1527 bp, Clostridium_asparagiforme
tttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatccccctgaccggcgtgtaacggcgcctttccttcgggacaggggagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctccttt

SEQ ID NO: 104 - DNA, 1528 bp, Blautia_wexlerae
tcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgactgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatggggagtcagtaacgcccgaagtcagtgacctaaccgaaagggaggagctgccgaaggcgggaccgatgactggggtgaagtcgtaacaaggtagccgtatcggaaggtgcggctggatcacctccttt

SEQ ID NO: 105 - DNA, 1526 bp, Blautia_wexlerae
cagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 106 - DNA, 1526 bp, Blautia_wexlerae
cagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtagcatagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgaaacttaatcggatctttccttcgggacagacgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 107 - DNA, 1325 bp, Blautia_wexlerae
tcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaa

SEQ ID NO: 108 - DNA, 1526 bp, Blautia_wexlerae; identical to SEQ ID NO: 105

SEQ ID NO: 109 - DNA, 1527 bp, Blautia_wexlerae
tcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccggaacttaatcgttcctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 110 - DNA, 1527 bp, Blautia_wexlerae
tcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccggaacttaatcgttcctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctccttt

SEQ ID NO: 111 - DNA, 1565 bp, Dialister_invisus
atggagagtttgatcctggctcaggacgaacgctggcggcgtgcttaacacatgcaagtcgaacgaaaagacggaaagagcttgctcttttcagaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgaggaagagcaaacctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcggctggatcacctccttt

SEQ ID NO: 112 - DNA, 1566 bp, Dialister_invisus
atggagagtttgatcctggctcaggacgaacgctggcggcgtgcttaacacatgcaagtcgaacgaaaagagggaaagagcttgctctttccggaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgaggaagagcaaacctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcggctggatcacctccttt

SEQ ID NO: 113 - DNA, 1566 bp, Dialister_invisus
atggagagtttgatcctggctcaggacgaacgctggcggcgtgcttaacacatgcaagtcgaacgaaaagacggaaagagcttgctcttttcagaattgagtggcaaacgggtgagtaacacgtaaacaacctgccttcaggatggggacaacagacggaaacgactgctaatgccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgaggaagagcaaacctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcggctggatcacctccttt

SEQ ID NO: 114 - DNA, 1527 bp, Dorea_formicigenerans
acgagagtttgatcctggctcaggatgaacgctggcggcgtgcttaacacatgcaagtcgagcgaagcacataagttcgattcttcggatgaagacttttgtgactgagcggcggacgggtgagtaacgcgtgggtaacctgcctcatacagggggataacagctagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccttatcttcagtagccagcattaaggatgggcactctggagagactgccagggataacctggaggaaggtggggatgacgtcaaatcatcatgccccttatgaccagggctacacacgtgctacaatggcgtaaacaaagggaggcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 115 - DNA, 1527 bp, Dorea_formicigenerans
acgagagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcattaaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 116 - DNA, 1527 bp, Dorea_formicigenerans
acgagagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccttatattcagtagccagcatttaggatgggcactctggagagactgccagggataacctggaggaaggtggggatgacgtcaaatcatcatgccccttatgaccagggctacacacgtgctacaatggcgtaaacaaagggaggcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 117 - DNA, 1527 bp, Dorea_formicigenerans
acgagagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaggcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 118 - DNA, 1296 bp, Dorea_formicigenerans
tatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagtttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaggcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 119 - DNA, 1527 bp, Dorea_formicigenerans
acgagagtttgatcctggctcaggatgaacgctggcggcgtgcttaacacatgcaagtcgagcgaagcacataagttcgattcttcggatgaagacttttgtgactgagcggcggacgggtgagtaacgcgtgggtaacctgcctcatacagggggataacagctagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttaggatgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctccttt

SEQ ID NO: 120 - DNA, 1424 bp, Eubacterium hallii
ctgagtggcggacgggtgagtaacgcgtgggtaacctgccctgtacagggggataacagctggaaacggctgctaataccgcataagcgcacgaggagacatctccttgtgtgaaaaactccggtggtacaggatgggcccgcgtctgattagctggttggcagggtaacggcctaccaaggcaacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgctcggctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggcttcggtgccgccgctaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggtaaggctgggcactctggagagactgccagggataacctggaggaaggtggggacgacgtcaaatcatcatgccccttatgatctgggcgacacacgtgctacaatggcggtcacagagtgaggcgaacccgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaaccttttggagggagctgtcgaaggtggagccggtaactggggtgaagtcgtaacaaggtagccgtatcggaaggtgcggctggatcacctccttt

SEQ ID NO: 121 - DNA, 1529 bp, Ruminococcaceae_bacterium_D16
tattgagagtttgatcctggctcaggatgaacgctggcggcgtgcttaacacatgcaagtcgaacggagtgcctttgaaagaggattcgtccaattgataaggttacttagtggcggacgggtgagtaacgcgtgaggaacctgccttggagtggggaataacacagtgaaaattgtgctaataccgcataatgcagttgggccgcatggctctgactgccaaagatttatcgctctgagatggcctcgcgtctgattagctagttggtggggtaacggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttcttagggacgaagcaagtgacggtacctaaggaataagccacggctaactacgtgccagcagccgcggtaatacgtaggtggcaagcgttatccggatttactgggtgtaaagggcgtgtaggcgggattgcaagtcagatgtgaaaaccacgggctcaacctgtggcctgcatttgaaactgtagttcttgagtactggagaggcagacggaattcctagtgtagcggtgaaatgcgtagatattaggaggaacaccagtggcgaaggcggtctgctggacagcaactgacgctgaggcgcgaaagcgtggggagcaaacaggattagataccctggtagtccacgctgtaaacgatggatactaggtgtggggggtctgaccccttccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccgaggcccggtctagagatagacctttctcttcggagacctcggtgacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaacccctaaaagccatcccagttcggattgcaggctgcaacccgcctgcatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctccttt

SEQ ID NO: 122 - DNA, 1544 bp, Streptococcus vestibularis
aatgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataacattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtaggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaaccgagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtgggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagaccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 123 - DNA, 1544 bp, Streptococcus vestibularis
aatgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 124 - DNA, 1543 bp, Streptococcus vestibularis
aatgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgtcgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagtaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccgtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtggggtagatgattggggtgaagtcgtaacaaggtagccgtatcggaaggtgcggctggatcacctcctt

SEQ ID NO: 125 - DNA, 1542 bp, Streptococcus vestibularis
aatgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataactattggaaacgatagctaataccgcataacaatggtgacacatgtcattatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 126 - DNA, 1544 bp, Streptococcus vestibularis; identical to SEQ ID NO: 123

SEQ ID NO: 127 - DNA, 1544 bp, Streptococcus vestibularis; identical to SEQ ID NO: 123

SEQ ID NO: 128 - DNA, 1544 bp, Streptococcus thermophilus
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcgggttgataagtctgaagttaaaggctggggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgaagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctgggtcacctcctt

SEQ ID NO: 129 - DNA, 1543 bp, Streptococcus thermophilus
atgaaagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctcactggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctt

SEQ ID NO: 130 - DNA, 1544 bp, Streptococcus thermophilus
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctt

SEQ ID NO: 131 - DNA, 1543 bp, Streptococcus thermophilus
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcgggttgataagtctgaagttaaaggctggggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggtcacctcctt

SEQ ID NO: 132 - DNA, 1543 bp, Streptococcus thermophilus
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcgggttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtgggcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctgggtcacctcctt

SEQ ID NO: 133 - DNA, 1408 bp, Prevotella buccae
cgtatccaaccttcccgcgaccaagggataacctgccgaaaggcagactaataccttatgtcctcctttgaaggcatctgacgaggagcaaagatccgtcggtcacggatggggatgcgtccgattagcttgttggcggggcaacggcccaccaaggcttcgatcggtaggggttctgagaggaaggccccccacactggaactgagacacggtccagactcctacgggaggcagcagtgaggaatattggtcaatgggcggaagcctgaaccagccaagtagcgtgcaggatgacggccctacgggttgtaaactgcttttatgcggggataaagttgcccacgcgtgggtttttgcaggtaccgcatgaataaggaccggctaattccgtgccagcagccgcggtaatacggaaggtccgggcgttatccggatttattgggtttaaagggagcgcaggccgccgtgcaagcgtgccgtgaaaagcagcggcccaaccgctgccctgcggcgcgaactgcttggcttgagtgcgccggaagcgggcggaattcgtggtgtagcggtgaaatgcttagatatcacgaagaaccccgattgcgaaggcagcccgctgtggcgccactgacgctgaggctcgaaggtgcgggtatcgaacaggattagataccctggtagtccgcacggtaaacgatggatacccgctgtccggcccgtacggtctgggcggccaagcgaaagcgttaagtatcccacctggggagtacgccggcaacggtgaaactcaaaggaattgacgggggcccgcacaagcggaggaacatgtggtttaattcgatgatacgcgaggaaccttacccgggcttgaattgcaggagaatgattcagagatgatgaagtccctcgggactcctgtgaaggtgctgcatggttgtcgtcagctcgtgccgtgaggtgtcggctcaagtgccataacgagcgcaacccctctccgcagttgccatcgggtcatgccgggcactctgcggacactgccgccgcaaggtgcgaggaaggtggggatgacgtcaaatcagcacggcccttacgtccggggccacacacgtgttacaatggccggcacagagggctgtccgcatgcaagtgcgggcgaatccccaaatccggtcccagttcggactggggtctgcaacccgaccccacgaagctggattcgctagtaatcgcgcatcagccatggcgcggtgaatacgttcccgggccttgtacacaccgcccgtcaagccatgaaagccgggggtgcctgaagtccgtgaccgcgagggtcggcctagggcaaaaccggtgattggggctaagtcgtaacaaggtagccgtaccggaaggtgcggctggaacacctccttt

SEQ ID NO: 134 - DNA, 1529 bp, Lachnospiraceae_bacterium_5_1_63FAA
atgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctccttt

SEQ ID NO: 135 - DNA, 1528 bp, Lachnospiraceae_bacterium_8_1_57FAA
aacgagagtttgatcctggctcaggatgaacgctggcggcgtgcctaacacatgcaagtcgagcgaagcactttgcttagattcttcggatgaagaggattgtgactgagcggcggacgggtgagtaacgcgtgggtaacctgcctcatacagggggataacagttagaaatgactgctaataccgcataagaccacagcaccgcatggtgcgggggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggatgggcaagtctgatgtgaaaacccggggctcaaccccgggactgcattggaaactgttcatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccgctgaccggacggtaatgcgtccttcccttcggggcagcggagacaggtggtgcatggttgtcgtcagctcgtgtcgtgagatgttgggttaagtcccgcaacgagcgcaacccctatctttagtagccagcggccaggccgggcactctagagagactgccggggataacccggaggaaggtggggatgacgtcaaatcatcatgccccttatgagcagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctccttt

SEQ ID NO: 136 - DNA, 1545 bp, Streptococcus_australis
aatgagagtttgatcctggctcaggatgaacgctggcggcgtgcctaatacatgcaagtagaacgctgaaggaaggagcttgctctttctggatgagttgcgaacgggtgagtaacgcgtaggtaacctgcctggtagcgggggataactattggaaacgatagctaataccgcataacagtagatgttgcatgatatctgcttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctt

SEQ ID NO: 137 - DNA, 1528 bp, Lachnospiraceae_bacterium_4_1_37FAA
aacgagagtttgatcctggctcaggatgaacgctggcggcgtgcttaacacatgcaagtcgaacgaagcacttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagctagttggtggggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctagagtgtcggagaggcaagcggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaccggcaagtaatgttgcctttccttcgggacagaggagacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 138 - DNA, 1544 bp, Streptococcus sanguis
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcatgatattaattatcgcatgataattaattgaaagatgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtatgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctt

SEQ ID NO: 139 - DNA, 1528 bp, Lachnospiraceae_bacterium_3_1_46FAA; identical to SEQ ID NO: 135

SEQ ID NO: 140 - DNA, 1528 bp, Lachnospiraceae_bacterium_6_1_63FAA
tcagagagtttgatcctggctcaggatgaacgctggcggcgtgcttaacacatgcaagtcgagcgaagcacttatcattgactcttcggaagatttgatatttgactgagcggcggacgggtgagtaacgcgtgggtaacctgcctcatacaggggaataacagttagaaatggctgctaatgccgcataagcgcacaggaccgcatggtctggtgtgaaaaactgaggtggtatgagatggacccgcgtctgattaggtagttggtggggtaacggcctaccaagccgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggtgcaaagcagttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccgttccttaaccggagctttccttcgggacaggcaagacaggtggtgcatggttgtcgtcagctcgtgtcgtgagatgttgggttaagtcccgcaacgagcgcaacccctatccttagtagccagcagtccggctgggcactctagggagactgccggggataacccggaggaaggcggggacgacgtcaaatcatcatgccccttatgatttgggctacacacgtgctacaatggcgtaaacaaagggaagcgaagcggtgacgcttagcaaatctcaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttatggagggagctgccgaaggcgggaccgataactggggtgaagtcgtaacaaggtagccgtatcggaaggtgcggctggatcacctccttt

SEQ ID NO: 141 - DNA, 1528 bp, Lachnospiraceae_bacterium_9_1_43BFAA
aacgagagtttgatcctggctcaggatgaacgctggcggcgtgcttaacacatgcaagtcgaacgaagcacttgaatggaattcttcggaaggaagctcaagtgactgagtggcggacgggtgagtaacgcgtgggtaacctgcctcatacagggggataacagttagaaatgactgctaataccgcataagcacacgtgatcgcatgatcgagtgtgaaaaactccggtggtatgagatggacccgcgtctgattagctagttggtggggtaatggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcagtgcaagtctgaagtgaaagcccggggctcaaccccgggactgctttggaaactgtgcagctagagtgtcggagaggcaagcggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcggggagcaaagctcttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatccctctgaccgctctttaatcggagctttccttcgggacagaggagacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcagagtcgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 142 - DNA, 1312 bp, Ruminococcus bromii
atatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctccttt

SEQ ID NO: 143 - DNA, 976 bp, Coprococcus_catus
  misc_feature (974)..(976): n is a, c, g, or t
atgagagtttgatcctggctcaggatgaacgctggcggcgtgcttaacacatgcaagtcgaacggacgatgaagagcttgcttttcaaagttagtggcggacgggtgagtaacgcgtgggtaacctgcctcatacagggggatagcagctggaaacggctgataaaaccgcataagcgcacagcatcgcatgatgcagtgtgaaaaactccggtggtatgagatggacccgcgtctgattagctggttggtgaggtaacggcccaccaaggcgacgatcagtagccggcctgagagggtgaccggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtaggcggcggagcaagtcagaagtgaaagcccggggctcaaccccgggacggcttttgaaactgccctgcttgatttcaggagaggtaagcggaattcctagtgtagcggtgaaatgcgtagatattaggaggaacaccagtggcgaaggcggcttactggactgacaatgacgctgaggctcgaaagcgtggggagcaaacaggattagataccctggtagtccacgccgtaaacgatgaatactaggtgtcgggggctcataagagctttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggccttgacatcccnnn

SEQ ID NO: 144 - DNA, 1522 bp, Dysgonomonas_mossii
agaagagtttgatcctggctcaggatgaacgctagcgataggcctaacacatgcaagtcgaggggcagcatagagtagcaatactttgatggcgaccggcgcacgggtgagtaacacgtatgcaacctacctacatcaggggaataacccggagaaattcggactaataccgcataatacagggatgccgcatggcaatatttgttaaagatttatcggatgtagatgggcatgcgttccattagctggttggtaaggtaacggcttaccaaggcaacgatggataggggaactgagaggtttgtcccccacactggaactgagacacggaccagactcctacgggaggcagcagtgaggaatattggtcaatggacgagagtctgaaccagccaaatcgcgtgaaggaagactgccctacgggttgtaaacttcttttgtacaggaataaaagacattacgtgtagtgtattgcatgtactgtacgaataagcatcggctaactccgtgccagcagccgcggtaatacggaggatgcgagcgttatccggatttattgggtttaaagggtgcgcaggcgggattttaagtcagcggtgaaattttcaggctcaacctgaacactgccgttgaaactgggattcttgagtatggatgaagtaggcggaattcgttgtgtagcggtgacatgcttagatataacgaggaactccgattgcgtaggcagcttactaagccataactgacgctcaagcacgaaagcgtggggatcaaacaggattagataccctggtagtccacgccgtaaacgatgattactagttgtttgcgatataccgtaagtgactaagcgaaagcgataagtaatccacctggggagtacgccggcaacggtgaaactcaaaggaattgacgggggcccgcacaagcggaggaacatgtggtttaattcgatgatacgcgaggaaccttacccgggcttgaaatgtacctgaccgtccttgaaaggggacttctagcaatagcaggtatgtaggtgctgcatggttgtcgtcagctcgtgccgtgaggtgtcggcttaagtgccataacgagcgcaacccacattattagttactaacaggttaagctgaggactctaataagactgccgtcgtaagatgcgaggaaggtgtggatgacgtcaaatcagcacggcccttacgtccggggcgacacacgtgttacaatgggaggtacaaagggctgctacctggtgacaggatgctaatccccaaagcctctcccagttcggatcggagtctgcaactcgactccgtgaagctggattcgctagtaatcgcgcatcagccatggcgcggtgaatacgttcccgggccttgtacacaccgcccgtcaagccatgggagccgggggtatctgaagtgcgtaaccgtaaggagcgtcctagggtaaaactggtgactggggctaagtcgtaacaaggtagccgtaccggaaggtgcggctggaacacctcctt

SEQ ID NO: 145 - DNA, 1528 bp, Lachnospiraceae_bacterium_1_4_56FAA
aacgagagtttgatcctggctcaggatgaacgctggcggcgtgcttaacacatgcaagtcgaacgaagcactttaccggatttcttcgggatgaaagttttgtgactgagtggcggacgggtgagtaacgcgtgggtaacctgcctcatacagggggataacagttagaaatgactgctaataccgcataagaccacaggattgcatgatccggtggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagaggcaagtctgatgtgaaaacccggggctcaaccccgggactgcattggaaactgtttttctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggaggcaaagcctttcggtgccgcagcaaacgcaataagcagtccacctggggagtacgttcgcaagaatgaaactcaaaggaattgacggggacccgcacaagcggtggagcatgtggtttaattcgaagcaacgcgaagaaccttacctgcccttgacatccggctgaccggcgagtaatgtcgcctttccttcgggacagccgagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgggcagggctacacacgtgctacaatggcgtaaacaaagggaggcaagcctgcgagggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 146 - DNA, 1527 bp, Lachnospiraceae_bacterium_3_1_57FAA_CT1
agagagtttgatcctggctcaggatgaacgctggcggcgtgcctaacacatgcaagtcgaacgaagttacacggaggaagttttcggatggaatcggtataacttagtggcggacgggtgagtaacgcgtgggaaacctgccctgtaccgggggataacacttagaaataggtgctaataccgcataagcgcacggaaccgcatggttccgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatcttgtaaaaaagagatgccttcgggacaggggagacaggtggtgcatggttgtcgtcagctcgtgtcgtgagatgttgggttaagtcccgcaacgagcgcaacccttattcttagtagccagcaggtaaggctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctccttt

SEQ ID NO: 147 - DNA, 1527 bp, Lachnospiraceae_bacterium_3_1_57FAA_CT1
agagagtttgatcctggctcaggatgaacgctggcggcgtgcctaacacatgcaagtcgaacgaagttatatcgaggaagttttcggatggaatcagtataacttagtggcggacgggtgagtaacgcgtgggaaacctgccctgtaccgggggataacacttagaaataggtgctaataccgcataagcgcacagcttcacatgaagcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgtcaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgactctcctgtaaaagagtgaggccttcgggacattggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctccttt

SEQ ID NO: 148 - DNA, 1527 bp, Lachnospiraceae_bacterium_3_1_57FAA_CT1
agagagtttgatcctggctcaggatgaacgctggcggcgtgcctaacacatgcaagtcgaacgaagttacacagaggaagttttcggatggaatcggtataacttagtggcggacgggtgagtaacgcgtgggaaacctgccctgtaccgggggataacacttagaaataggtgctaataccgcataagcgcacggattcacatgaagcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgtcaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgcacctgtaaagaggtgttcccttcggggcattggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctccttt

SEQ ID NO: 149 - DNA, 1532 bp, Lachnospiraceae_bacterium_5_1_57FAA
aacgagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattatggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctccttt

SEQ ID NO: 150 - DNA, 1528 bp, Lachnospiraceae_bacterium_1_1_57FAA; identical to SEQ ID NO: 135

SEQ ID NO: 151 - DNA, 1529 bp, Lachnospiraceae_bacterium_2_1_58FAA
aacgagagtttgatcctggctcaggatgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacggctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcattttcggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 152 - DNA, 1528 bp, Roseburia_hominis
atgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacaaagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctccttt

SEQ ID NO: 153 - DNA, 1528 bp, Roseburia_hominis
atgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctccttt

SEQ ID NO: 154 - DNA, 1528 bp, Roseburia_hominis; identical to SEQ ID NO: 153

SEQ ID NO: 155 - DNA, 1528 bp, Roseburia_hominis
atgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccggtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacagagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctccttt

SEQ ID NO: 156 - DNA, 1536 bp, Erysipelotrichaceae_bacterium_2_2_44A
atggagagtttgatcctggctcaggatgaacgctggcggcatgcctaatacatgcaagtcgaacgaagcttcaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 157 - DNA, 1426 bp, Clostridium_citroniae
  misc_feature (1422)..(1426): n is a, c, g, or t
tttgagagtttgatcctggctcaggatgaacgctggcggcgtgcctaacacatgcaagtcgaacgaagcaatcagaatgaaattttcggatggatttctggttgactgagtggcggacgggtgagtaacgcgtggataacctgcctcacactgggggataacagttagaaatggctgctaataccgcataagcgcacagtaccgcatggtacggtgtgaaaaactccggtggtgtgagatggatccgcgtctgattagttagttggcggggtaacggcccaccaagacagcgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggtcagtaaagtgacctttccttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgaccctgcgaaggcaagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaannnnn

SEQ ID NO: 158 - DNA, 1530 bp, Flavonifractor_plautii
tattgagagtttgatcctggctcaggatgaacgctggcggcgtgcttaacacatgcaagtcgaacggggtgctcatgacggaggattcgtccaatggattgagttacctagtggcggacgggtgagtaacgcgtgaggaacctgccttggagaggggaataacactccgaaaggagtgctaataccgcatgaagcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaggcagagatgcgttaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctccttt

SEQ ID NO: 159 - DNA, 1530 bp, Lachnospiraceae_bacterium_7_1_58FAA
tattgagagtttgatcctggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggagtgctaataccgcatgatgcagttgggtcgcatggctctgactgccaaagatttatcgctctgagatggcctcgcgtctgattagctagtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaagcagagatgcattaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggttaacagagggaggcaataccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctccttt

SEQ ID NO: 160 - DNA, 1587 bp, Erysipelotrichaceae_bacterium_6_1_45
  misc_feature (215)..(314): n is a, c, g, or t
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtaacggctcaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggatcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcggccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 161 - DNA, 1537 bp, Erysipelotrichaceae_bacterium_6_1_45
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgtccatcaaggcgtgaacatggatggacctgcggcgcattagctagttggtgaggtaacggctcaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcttggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcggccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 162 - DNA, 1537 bp, Erysipelotrichaceae_bacterium_6_1_45
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggatcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcggccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 163 - DNA, 1537 bp, Erysipelotrichaceae_bacterium_6_1_45; identical to SEQ ID NO: 162

SEQ ID NO: 164 - DNA, 1537 bp, Erysipelotrichaceae_bacterium_6_1_45
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatgcaaatgttctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcggccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 165 - DNA, 997 bp, Erysipelotrichaceae_bacterium_21_3
atggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacat

SEQ ID NO: 166 - DNA, 1537 bp, Erysipelotrichaceae_bacterium_21_3; identical to SEQ ID NO: 164

SEQ ID NO: 167 - DNA, 1537 bp, Erysipelotrichaceae_bacterium_21_3; identical to SEQ ID NO: 164

SEQ ID NO: 168 - DNA, 1537 bp, Erysipelotrichaceae_bacterium_21_3; identical to SEQ ID NO: 164

SEQ ID NO: 169 - DNA, 1536 bp, Haemophilus parainfluenzae
ttgaagagtttgatcatggctcagattgaacgctggcggcaggcttaacacatgcaagtcgaacggtaacataaagaagcttgcttctttgatgacgagtggcggacgggtgagtaatgcttgggaatctagcttatggagggggataactacgggaaactgtagctaataccgcgtagaatcgggagatgaaagtgtgggaccttcgggccacatgccataggatgagcccaagtgggattaggtagttggtgaggtaaaggctcaccaagccgacgatctctagctggtctgagaggatgaccagccacactgggactgagacacggcccagactcctacgggaggcagcagtggggaatattgcgcaatgggggcaaccctgacgcagccatgccgcgtgaatgaagaaggccttcgggttgtaaagttctttcggtagcgaggaaggcatttagtttaataaactggatgattgacgttaactacagaagaagcaccggctaactccgtgccagcagccgcggtaatacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgagctttaagtttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaacattccagagatggattggtgccttcgggaactctgagacaggtgctgcatggctgtcgtcagctcgtgttgtgaaatgttgggttaagtcccgcaacgagcgcaacccttatcctttgttgccagcgatttggtcgggaactcaaaggagactgccggtgataaaccggaggaaggtggggatgacgtcaagtcatcatggcccttacgagtagggctacacacgtgctacaatggcgtatacagagggaagcgagagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctcctt

SEQ ID NO: 170 - DNA, 1547 bp, Streptococcus parasanguis
taatgagagtttgatcctggctcaggatgaacgctggcggcgtgcctaatacatgcaagtagaacgctgaagcttggtgcttgcaccgagcggaggagttgcgaacgggtgagtaacgcgtaggtaacctgcctcttagcgggggataactattggaaacgatagctaataccgcataaaagtcgacattgcatgatgttgacttgaaaggtgcaactgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctccttt

SEQ ID NO: 171 - DNA, 1546 bp, Streptococcus parasanguis
taatgagagtttgatcctggctcaggatgaacgctggcggcgtgcctaatacatgcaagtagaacgctgaagcttggtgcttgcaccgagcggaggagttgcgaacgggtgagtaacgcgtaggtaacctgcctcttagcgggggataactattggaaacgatagctaataccgcataaaagtcgacattgcatgatgttgacttgaaaggtgcaaatgcatcactgagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctccttt

SEQ ID NO: 172 - DNA, 1547 bp, Streptococcus parasanguis; identical to SEQ ID NO: 170

SEQ ID NO: 173 - DNA, 1545 bp, Streptococcus parasanguis
aatgagagtttgatcctggctcaggatgaacgctggcggcgtgcctaatacatgcaagtagaacgctgaagcttggtgcttgcaccgagcggatgagttgcgaacgggtgagtaacgcgtaggtaacctacctcttagcgggggataactattggaaacgatagctaataccgcataaaagtcggcattgcatgatgttgacttgaaaggtgcaaatgcatcactgagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctt

SEQ ID NO: 174 - DNA, 1528 bp, Bacteroides_dorei
atgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctt

SEQ ID NO: 175 - DNA, 1528 bp, Bacteroides_dorei; identical to SEQ ID NO: 174

SEQ ID NO: 176 - DNA, 1528 bp, Bacteroides_dorei; identical to SEQ ID NO: 174

SEQ ID NO: 177 - DNA, 1528 bp, Bacteroides_dorei; identical to SEQ ID NO: 174

SEQ ID NO: 178 - DNA, 1528 bp, Bacteroides_dorei; identical to SEQ ID NO: 174

SEQ ID NO: 179 - DNA, 1528 bp, Bacteroides_dorei; identical to SEQ ID NO: 174

SEQ ID NO: 180 - DNA, 1528 bp, Bacteroides_dorei; identical to SEQ ID NO: 174

SEQ ID NO: 181 - DNA, 1528 bp, Bacteroides_dorei; identical to SEQ ID NO: 174

SEQ ID NO: 182 - DNA, 1528 bp, Bacteroides_dorei; identical to SEQ ID NO: 174

SEQ ID NO: 183 - DNA, 1528 bp, Bacteroides_dorei; identical to SEQ ID NO: 174

SEQ ID NO: 184 - DNA, 1525 bp, Bacteroides fragilis
atgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatagcataatgattccgcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgttagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 185 - DNA, 1302 bp, Bacteroides fragilis
aaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatcttcagttactaacaggttatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 186 - DNA, 1525 bp, Bacteroides fragilis
atgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatagtataatgattccgcatggtttcattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgttagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 187 - DNA, 1331 bp, Bacteroides fragilis
gcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatctttagttactaacaggttatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 188 - DNA, 1525 bp, Bacteroides fragilis
atgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatagtataatgattccgcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatctttagttactaacaggttatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 189 - DNA, 1525 bp, Bacteroides fragilis
atgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatggcataatgattccgcatggtttcattattaaaggattccggtaaaggatggggatgcgttccattaggttgttggtgaggtaacggcccaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 190 - DNA, 1525 bp, Bacteroides fragilis
atgaagagtttgatcctggctcaggatgaacgctagctacaggcttaacacatgcaagtcgaggggcatcaggaagaaagcttgctttctttgctggcgaccggcgcacgggtgagtaacacgtatccaacctgccctttactcggggatagcctttcgaaagaaagattaatacccgatggcataatgattccgcatggtttcattattaaaggattccggtaaaggatggggatgcgttccattaggttgttggtgaggtaacggctcaccaagccttcgatggataggggttctgagaggaaggtcccccacattggaactgagacacggtccaaactcctacgggaggcagcagtgaggaatattggtcaatgggcgctagcctgaaccagccaagtagcgtgaaggatgaaggctctatgggtcgtaaacttcttttatataagaataaagtgcagtatgtatactgttttgtatgtattatatgaataaggatcggctaactccgtgccagcagccgcggtaatacggaggatccgagcgttatccggatttattgggtttaaagggagcgtaggtggactggtaagtcagttgtgaaagtttgcggctcaaccgtaaaattgcagttgatactgtcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcagtggaatgatgtggaaacatgtcagtgagcaatcaccgctgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctagcgggtgaccgtatgctaatcccaaaagcctctctcagttcggatcgaagtctgcaacccgacttcgtgaagctggattcgctagtaatcgcgcatcagccacggcgcggtgaatacgttcccgggccttgtacacaccgcccgtcaagccatgggagccgggggtacctgaagtacgtaaccgcaaggatcgtcctagggtaaaactggtgactggggctaagtcgtaacaaggtagccgtaccggaaggtgcggctggaacacctcctt

SEQ ID NO: 191 - DNA, 1525 bp, Bacteroides fragilis; identical to SEQ ID NO: 189

SEQ ID NO: 192 - DNA, 1202 bp, Bacteroides uniformis
actgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgtaccggaaggtgcggctggaacacctcctt

SEQ ID NO: 193 - DNA, 1523 bp, Bacteroides uniformis
atgaagagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtggaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgtaccggaaggtgcggctggaacacctcctt

SEQ ID NO: 194 - DNA, 1202 bp, Bacteroides uniformis; identical to SEQ ID NO: 192

SEQ ID NO: 195 - DNA, 1523 bp, Bacteroides uniformis
atgaagagtttgatcctggctcaggatgaacgctagctacaggcttaacacatgcaagtcgaggggcagcatgaacttagcttgctaagtttgatggcgaccggcgcacgggtgagtaacacgtatccaacctgccgatgactcggggatagcctttcgaaagaaagattaatacccgatggcatagttcttccgcatggtagaactattaaagaatttcggtcatcgatggggatgcgttccattaggttgttggcggggtaacggcccaccaagccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatacgggaataaagtgaggcacgtgtgcctttttgtatgtaccgtatgaataaggatcggctaactccgtgccagcagccgcggtaatacggaggatccgagcgttatccggatttattgggtttaaagggagcgtaggcggacgcttaagtcagttgtgaaagtttgcggctcaaccgtaaaattgcagttgatactgggtgtcttgagtacagtagaggcaggcggaattcgtggtgtagcggtgaaatgcttagatatcacgaagaactccgattgcgaaggcagcttgctggactgtaactgacgctgatgctcgaaagtgtgggtatcaaacaggattagataccctggtagtccacacagtaaacgatgaatactcgctgtttgcgatatacagtaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttgaattgcaactgaatgatgtggagacatgtcagccgcaaggcagttgtgaaggtgctgcatggttgtcgtcagctcgtgccgtgaggtgtcggcttaagtgccataacgagcgcaacccttatcgatagttaccatcaggttatgctggggactctgtcgagactgccgtcgtaagatgtgaggaaggtggggatgacgtcaaatcagcacggcccttacgtccggggctacacacgtgttacaatggggggtacagaaggcagctacacggcgacgtgatgctaatcccgaaagcctctctcagttcggattggagtctgcaacccgactccatgaagctggattcgctagtaatcgcgcatcagccacggcgcggtgaatacgttcccgggccttgtacacaccgcccgtcaagccatgaaagccgggggtacctgaagtgcgtaaccgcaaggagcgccctagggtaaaactggtgattggggctaagtcgtaacaaggtagccgtaccggaaggtgcggctggaacacctcctt

SEQ ID NO: 196 - DNA, 1523 bp, Bacteroides uniformis; identical to SEQ ID NO: 193

SEQ ID NO: 197 - DNA, 1523 bp, Bacteroides uniformis; identical to SEQ ID NO: 195

SEQ ID NO: 198 - DNA, 1523 bp, Bacteroides uniformis; identical to SEQ ID NO: 195

SEQ ID NO: 199 - DNA, 1051 bp, Bacteroides vulgatus
tttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttctgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctccttt

SEQ ID NO: 200 - DNA, 1524 bp, Bacteroides vulgatus
atgaagagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagttcacatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatggatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttctgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctcctt

SEQ ID NO: 201 - DNA, 1524 bp, Bacteroides vulgatus
atgaagagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtaggcgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatgtatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttctgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctcctt

SEQ ID NO: 202 - DNA, 1524 bp, Bacteroides vulgatus
atgaagagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttccgctgaggactctgacaagactgccatcgtaagatgtgaggaaggtggggatgacgtcaaatcagcacggcccttacgtccggggctacacacgtgttacaatggggggtacagagggtcgctaccacgcgagtggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctcctt

SEQ ID NO: 203 - DNA, 1524 bp, Bacteroides vulgatus
atgaagagtttgatcctggctcaggatgaacgctagctacaggcttaacacatgcaagtcgaggggcagcatggtcttagcttgctaaggccgatggcgaccggcgcacgggtgagtaacacgtatccaacctgccgtctactcttggacagccttctgaaaggaagattaatacaagatggcatcatgagtccgcatgttcacatgattaaaggtattccggtagacgatggggatgcgttccattagatagtaggcggggtaacggcccacctagtcttcgatggataggggttctgagaggaaggtcccccacattggaactgagacacggtccaaactcctacgggaggcagcagtgaggaatattggtcaatgggcgagagcctgaaccagccaagtagcgtgaaggatgactgccctatgggttgtaaacttcttttataaaggaataaagtcgggtatggatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttctgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatcccaaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctcctt

SEQ ID NO: 204 - DNA, 1054 bp, Bacteroides vulgatus
ccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatatcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacagcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcagatgaattacggtgaaagccgtaagccgcaaggcatctgtgaaggtgctgcatggttgtcgtcagctcgtgccgtgaggtgtcggcttaagtgccataacgagcgcaacccttgttgtcagttactaacaggttctgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccccaaaacctctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggagcgccctagggtaaaactggtgactggggctaagtcgtaacaaggtagccgtaccggaaggtgcggctggaacacctccttt

SEQ ID NO: 205 - DNA, 1535 bp, Eubacterium_sp_3_1_31
atggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccacatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaggttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctccttt

SEQ ID NO: 206 - DNA, 1535 bp, Eubacterium_sp_3_1_31; identical to SEQ ID NO: 205

SEQ ID NO: 207 - DNA, 1535 bp, Eubacterium_sp_3_1_31
atggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaggttggggactcaggagagactgccggtgacaaaccggaggaaggtggggatgacgtcaaatcatcatgccccttatggcctgggctacacacgtactacaatggcgcctacaaagagcagcgacaccgcgaggtgaagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctccttt

SEQ ID NO: 208 - DNA, 1535 bp, Eubacterium_sp_3_1_31
atggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccacatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctccttt

SEQ ID NO: 209 - DNA, 1535 bp, Eubacterium_sp_3_1_31
atggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaggttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctccttt

SEQ ID NO: 210 - DNA, 1544 bp, Streptococcus salivarius
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 211 - DNA, 1544 bp, Streptococcus salivarius
aatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatgaatgactcatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 212 - DNA, 1544 bp, Streptococcus salivarius; identical to SEQ ID NO: 211

SEQ ID NO: 213 - DNA, 1547 bp, Streptococcus salivarius
aatgagagtttgaccttcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatgaatgactcatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctt

SEQ ID NO: 214 - DNA, 1544 bp, Streptococcus salivarius; identical to SEQ ID NO: 211

SEQ ID NO: 215 - DNA, 1544 bp, Streptococcus salivarius; identical to SEQ ID NO: 211

SEQ ID NO: 216 - DNA, 1544 bp, Streptococcus salivarius; identical to SEQ ID NO: 210

SEQ ID NO: 217 - DNA, 1521 bp, Parabacteroides_distasonis
cgaagagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggtcccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctccttt

SEQ ID NO: 218 - DNA, 1521 bp, Parabacteroides_distasonis
cgaagagtttgatcctggctcaggatgaacgctagcgacaggcttaacacatgcaagtcgaggggcagcacaggtagcaataccgggtggcgaccggcgcacgggtgagtaacgcgtatgcaacttgcctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgcgagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggatgccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctccttt

SEQ ID NO: 219 - DNA, 1521 bp, Parabacteroides_distasonis
cgaagagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggtcccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgcgagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtgatgctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgaaaggatcggcctagggtaaaactggtgactggggctaagtcgtaacaaggtagccgtaccggaaggtgcggctggaacacctccttt

SEQ ID NO: 220 - DNA, 1521 bp, Parabacteroides_distasonis
cgaagagtttgatcctggctcaggatgaacgctagcgacaggcttaacacatgcaagtcgaggggcagcgggggtagcaatacccgccggcgaccggcgcacgggtgagtaacgcgtatgcaacttacctatcagagggggataacccggcgaaagtcggactaataccgcatgaagcaggggccccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgcgagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaatgctgaggactctggtgggactgccagcgtaagctgcgaggaaggcggggatgacgtcaaatcagcacggcccttacatccggggcgacacacgtgttacaatggcgtggacaaagggaggccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctccttt

SEQ ID NO: 221 - DNA, 1521 bp, Parabacteroides_distasonis
cgaagagtttgatcctggctcaggatgaacgctagcgacaggcttaacacatgcaagtcgaggggcagcacaggtagcaataccgggtggcgaccggcgcacgggtgagtaacgcgtatgcaacttacctatcagagggggataacccggcgaaagtcggactaataccgcatgaagcaggggtcccgcatggggatatttgctaaagattcatcgctgatagataggcatgcgttccattaggcagttggcggggtaacggcccaccaaaccgacgatggataggggttctgagaggaaggtcccccacattggtactgagacacggaccaaactcctacgggaggcagcagtgaggaatattggtcaatgggcgtaagcctgaaccagccaagtcgcgtgagggatgaaggttctatggatcgtaaacctcttttataagggaataaagtgcgggacgtgtcctgttttgtatgtaccttatgaataaggatcggctaactccgtgccagcagccgcggtaatacggaggatccgagcgttatccggatttattgggtttaaagggtgcgtaggcggccttttaagtcagcggtgaaagtctgtggctcaaccatagaattgccgttgaaactggggggcttgagtatgtttgaggcaggcggaatgcgtggtgtagcggtgaaatgcttagatatcacgcagaaccccgattgcgaaggcagcctgccaagccatgactgacgctgatgcacgaaagcgtggggatcaaacaggattagataccctggtagtccacgcagtaaacgatgatcactagctgtttgcgatacagtgtaagcggcacagcgaaagcgttaagtgatccacctggggagtacgccggcaacggtgaaactcaaaggaattgacgggggcccgcacaagcggaggaacatgtggtttaattcgatgatacgcgaggaaccttacccgggtttgaacgcattcggaccgaggtggaaacaccttttctagcaatagccgtttgcgaggtgctgcatggttgtcgtcagctcgtgccgtgaggtgtcggcttaagtgccataacgagcgcaacccttgccactagttactaacaggtaaagctgaggactctggtgggactgccagcgtaagctgcgaggaaggcggggatgacgtcaaatcagcacggcccttacatccggggcgacacacgtgttacaatggcgtggacaaagggaagccacctggcgacagggagcgaatccccaaaccacgtctcagttcggatcggagtctgcaacccgactccgtgaagctggattcgctagtaatcgcgcatcagccatggcgcggtgaatacgttcccgggccttgtacacaccgcccgtcaagccatgggagccgggggtacctgaagtccgtaaccgcgaggatcggcctagggtaaaactggtgactggggctaagtcgtaacaaggtagccgtaccggaaggtgcggctggaacacctccttt

SEQ ID NO: 222 - DNA, 1531 bp, Clostridiaceae_bacterium_JC118
atggagagtttgatcctggctcaggatgaacgctggcggcatgcctaatacatgcaagtcgaacgaagtgaagatagcttgctattggaacttagtggcgaacgggtgagtaacacgtagataacctgcctgtatgaccgggataacagttggaaacgactgctaataccggataggcagagaggaggcatctcttctctgttaaagttgggacacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcaacgcgaagaaccttaccaggccttgacatggtatcaaaggccctagagatagggagatagttatggtacacacaggtggtgcatggttgtcgtcagctcgtgtcgtgagatgttgggttaagtcccgcaacgagcgcaacccttgtttctagttaccaacagtaagatggggactctagagagactgccggtgacaaaccggaggaaggtggggatgacgtcaaatcatcatgccccttatggcctgggctacacacgtactacaatggcgtctacaaagagcagcgagcaggtgactgtgagcgaatctcataaaggacgtctcagttcggattgaagtctgcaactcgacttcatgaagtcggaatcgctagtaatcgcggatcagcatgccgcggtgaatacgttctcgggccttgtacacaccgcccgtcaaaccatgggagttgataatacccgaagccggtggcctaaccatttatggagggagccgtcgaaggtaggatcgatgactggggttaagtcgtaacaaggtatccctacgggaacgtggggatggatcacctccttt

SEQ ID NO: 223 - DNA, 981 bp, Anaerostipes_hadrus
acctaccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagca

SEQ ID NO: 224 - DNA, 1537 bp, Clostridium innocuum
atggagagtttgatcctggctcaggatgaacgctggcggcatgcctaatacatgcaagtcgaacgaagactctaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 225 - DNA, 1537 bp, Clostridium innocuum
atggagagtttgatcctggctcaggatgaacgctggcggcatgcctaatacatgcaagtcgaacgaagtcttcaggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 226 - DNA, 1537 bp, Clostridium innocuum
atggagagtttgatcctggctcaggatgaacgctggcggcatgcctaatacatgcaagtcgaacgaagtcttcaggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccttcaaggcgtgaacatggatggacctgcgacgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggagaaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 227 - DNA, 1537 bp, Clostridium innocuum
atggagagtttgatcctggctcaggatgaacgctggcggcatgcctaatacatgcaagtcgaacgaagtcttcaggaagcttgcttccaaaaagacttagtggcgaacgggtgagtaacacgtaggtaacctgcccatgtgtccgggataactgctggaaacggtagctaaaaccggataggtatacggagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 228 - DNA, 1537 bp, Clostridium innocuum
atggagagtttgatcctggctcaggatgaacgctggcggcatgcctaatacatgcaagtcgaacgaagtctttaggaagcttgcttccaaaaagacttagtggcgaacgggtgagtaacacgtaggtaacctgcccatgtgtccgggataactgctggaaacggtagctaaaaccggataggtatacggagcgcatgctctgtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaagaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctccttt

SEQ ID NO: 229 - DNA, 1528 bp, Clostridium_hathewayi
atgagagttcgatcctggctcaggatgaacgctggcggcgtgcttaacacatgcaagtcgagcgaagcggtttcaatgaagttttcggatggaattgaaattgacttagcggcggacgggtgagtaacgcgtgggtaacctgccttacactgggggataacagttagaaatgactgctaataccgcataagcgcacagggccgcatggtctggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaacgtccttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaacactttaaccggtgtccctcttcggagcaatggagacaggtggtgcatggttgtcgtcagctcgtgtcgtgagatgttgggttaagtcccgcaacgagcgcaacccttatccttagtagccagcacatgatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctccttt

SEQ ID NO: 230 - DNA, 927 bp, Clostridium_hathewayi
atgagagttcgatcctggctcaggatgaacgctggcggcgtgcttaacacatgcaagtcgagcgaagcggtttcaatgaagttttcggatggatttgaaattgacttagcggcggacgggtgagtaacgcgtgggtaacctgccttacactgggggataacagttagaaatgactgctaataccgcataagcgcacagggccgcatggtctggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaaagtccttcggtgccgccgctaacgcaataagtattccacctggggagtacgttcgcaagaatgaaactcaaaggaattgacggggacccgcacaagcgg

SEQ ID NO: 231 - DNA, 1528 bp, Clostridium clostridiiforme
atgagagtttgatcctggctcaggatgaacgctggcggcgtgcctaacacatgcaagtcgaacgaagcaattaaaggaagttttcggacggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccttttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggcggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 232 - DNA, 1528 bp, Clostridium clostridiiforme
atgagagtttgatcctggctcaggatgaacgctggcggcgtgcctaacacatgcaagtcgaacgaagcaattaaaggaagttttcggatggaatttgattgactgagtggcggacgggtgagtaacgcgtggataacctgcctcacactgggggataacagttagaaatgactgctaataccgcataagcgcacagtgccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 233 - DNA, 1528 bp, Clostridium clostridiiforme
atgagagtttgatcctggctcaggatgaacgctggcggcgtgcctaacacatgcaagtcgaacgaagcaattaaaggaagttttcggatggaatttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttggccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtagagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 234 - DNA, 1573 bp, Lactobacillus fermentum
tatgagagtttgatcctggctcaggatgaacgccggcggtgtgcctaatacatgcaagtcgaacgcgttggcccgattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctccttt

SEQ ID NO: 235 - DNA, 1573 bp, Lactobacillus fermentum
tatgagagtttgatcctggctcaggatgaacgccggcggtgtgcctaatacatgcaagtcgaacgcgttggcccaattgattgacggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctccttt

SEQ ID NO: 236 - DNA, 1573 bp, Lactobacillus fermentum
tatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctccttt

SEQ ID NO: 237 - DNA, 1572 bp, Lactobacillus fermentum
tatgagagtttgatcctggctcaggatgaacgccggcggtgtgcctaatacatgcaagtcgaacgcgttggtccaattgattgacggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgtttaaaagatggcttctcgctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctt

SEQ ID NO: 238 - DNA, 1572 bp, Lactobacillus fermentum
tatgagagtttgatcctggctcaggatgaacgccggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcgctgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgtgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctt

SEQ ID NO: 239 - DNA, 1137 bp, Bacteroides thetaiotaomicron
ctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 240 - DNA, 1137 bp, Bacteroides thetaiotaomicron; identical to SEQ ID NO: 239

SEQ ID NO: 241 - DNA, 1525 bp, Bacteroides thetaiotaomicron
atgaagagtttgatcctggctcaggatgaacgctagctacaggcttaacacatgcaagtcgaggggcagcatttcagtttgcttgcaaactggagatggcgaccggcgcacgggtgagtaacacgtatccaacctgccgataactcggggatagcctttcgaaagaaagattaatacccgatagtataattagaccgcatggtcttattattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 242 - DNA, 1525 bp, Bacteroides thetaiotaomicron
atgaagagtttgatcctggctcaggatgaacgctagctacaggcttaacacatgcaagtcgaggggcagcatttcagtttgcttgcaaactggagatggcgaccggcgcacgggtgagtaacacgtatccaacctgccgataactcggggatagcctttcgaaagaaagattaatacccgatggtataattagaccgcatggtcttgttattaaagaatttcggttatcgatggggatgcgttccattaggcagttggtgaggtaacggctcaccaaaccttcgatggataggggttctgagaggaaggtcccccacattggaactgagacacggtccaaactcctacgggaggcagcagtgaggaatattggtcaatgggcgcaggcctgaaccagccaagtagcgtgaaggatgactgccctatgggttgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggacagttaagtcagttgtgaaagtttgcggctcaaccgtaaaattgcagttgatactggctgtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcatttgaatatattggaaacagtatagccgtaaggcaaatgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcagctacctggtgacaggatgctaatcccaaaagcctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 243 - DNA, 1531 bp, Sutterella_wadsworthensis
taaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgtattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctggggcatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggtctgagagatcagaccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggtgaagtcgtaacaaggtagccgtaccggaaggtgcggctggatcacctccttt

SEQ ID NO: 244 - DNA, 921 bp, Sutterella_wadsworthensis
  misc_feature (921)..(921): n is a, c, g, or t
taaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgtattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacgggn

SEQ ID NO: 245 - DNA, 1531 bp, Sutterella_wadsworthensis
taaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgtccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgtattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaacccttccctagccttgacatgccaggaaggtctgagagatcagaccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggtgaagtcgtaacaaggtagccgtaccggaaggtgcggctggatcacctccttt

SEQ ID NO: 246 - DNA, 1531 bp, Sutterella_wadsworthensis
taaagagtttgatcctggctcagattgaacgctggcggcatgctttacacatgcaagtcgaacggcagcgcggggagcttgctccctggcggcgagtggcgcacgggtgagtaatacatcggaacgtgtcttctagtgggggataactgcccgaaagggcagctaataccgcatgagacctgagggtgaaagcgggggatcgcaagacctcgcgctggaagagcggccgatgtccgattagctagttggtgaggtaaaggctcaccaaggcgacgatcggtagctggtctgagaggacgaccagccacactgggactgagacacggcccagactcctacgggaggcagcagtggggaattttggacaatgggggcaaccctgatccagccatgccgcgtgcaggatgaaggtcttcggattgtaaactgcttttgtcagggacgaaaagggatgcgataacaccgtattccgctgacggtacctgaagaataagcaccggctaactacgtgccagcagccgcggtaatacgtagggtgcaagcgttaatcggaattactgggcgtaaagcgtgcgcaggcggttctgtaagatagatgtgaaatccccgggctcaacctgggaattgcatatatgactgcaggacttgagtttgtcagaggagggtggaattccacgtgtagcagtgaaatgcgtagatatgtggaagaacaccgatggcgaaggcagccctctgggacatgactgacgctcatgcacgaaagcgtggggagcaaacaggattagataccctggtagtccacgccctaaacgatgtctactagttgttggggacgatagtccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaaggcctgagagatcaggccgtgcccgcaagggaatctggacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatggctagggcctcacacgtcatacaatggtcggaacagagggaagcgaagccgcgaggtgaagccaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcccaaccgaaaggaaggcggcgtccacggtgggcttcatgactggggtgaagtcgtaacaaggtagccgtaccggaaggtgcggctggatcacctccttt

SEQ ID NO: 247 - DNA, 1527 bp, Clostridium_sp_KLE_1755
agagagtttgatcctggctcaggatgaacgctggcggcgtgcctaacacatgcaagtcgaacggagttatgcagaggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgcccgtaacggggcattctcttcggagcattggagacaggtggtgcatggttgtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgtaaggaaggagcagtcgaaggcaggtctaataactggggtgaagtcgtaacaaggtagccgtatcggaaggtgcggctggatcacctccttt

SEQ ID NO: 248 - DNA, 1527 bp, Clostridium symbiosum
atgagagtttgatcctggctcaggatgaacgctggcggcgtgcctaacacatgcaagtcgaacgaagcgatttaacggaagttttcggatggaagttgaattgactgagtggcggacgggtgagtaacgcgtgggtaacctgccttgtactgggggacaacagttagaaatgactgctaataccgcataagcgcacagtattgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatccgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctccttt

SEQ ID NO: 249 - DNA, 1432 bp, Eubacterium ramulus
gttctgtgactgagtggcggacgggtgagtaacgcgtggataacctgcctcacacagggggataacagttggaaacgactgctaataccgcataagcgcacagcaccgcatggtgcagtgtgaaaaactccggtggtgtgagatggatccgcgtctgattagcttgttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagataatgacggtacctgactaagaagctccggctaaatacgtgccagcagccgcggtaatacgtatggagcaagcgttatccggatttactgggtgtaaagggagcgtaggcggtcctgcaagtctgatgtgaaaggccggggctcaaccccgggactgcattggaaactgtaggactagagtgtcggaggggtaagtggaattcctagtgtagcggtgaaatgcgtagatattaggaggaacaccagtggcgaaggcggcttactggacgactactgacgctgaggctcgaaagcgtggggagcaaacaggattagataccctggtagtccacgccgtaaacgatgaatactaggtgttggcaggtaagacctgtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacagaacatgtaatgtgttttcccttcggggcaccggtgacaggtggtgcatggttgtcgtcagctcgtgtcgtgagatgttgggttaagtcccgcaacgagcgcaacccttatccccagtagccagcatttcggatgggcactctgtggagactgccagggacaacctggaggaaggtggggatgacgtcaaatcatcatgccccttatgacttgggctacacacgtgctacaatggcgtaaacaaagggaagcgagaccgcgaggtggagcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccggtggcctaaccgcaaggaaggagccgtcgaaggcaggtctgataactggggtgaagtcgtaacaaggtagccgtatcggaaggtgcggctggatcacctccttt

SEQ ID NO: 250 - DNA, 1528 bp, Ruminococcus gnavus
aacgagagtttgatcctggctcaggatgaacgctggcggcgtgcttaacacatgcaagtcgagcgaagcacttttgcggatttcttcggattgaagcaattgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccccctgaccgctctttaatcggagctttccttcgggacaggggagacaggtggtgcatggttgtcgtcagctcgtgtcgtgagatgttgggttaagtcccgcaacgagcgcaacccctatctttagtagccagcatttcggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 251 - DNA, 1528 bp, Ruminococcus gnavus
aacgagagtttgatcctggctcaggatgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacggctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcattttggatgggcactctagagagactgccagggataacctggaggaaggtggggatgacgtcaaatcatcatgccccttatgatcagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 252 - DNA, 1528 bp, Ruminococcus gnavus
aacgagagtttgatcctggctcaggatgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacggctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccccctgaccgctctttaatcggagctttccttcgggacagaggagacaggtggtgcatggttgtcgtcagctcgtgtcgtgagatgttgggttaagtcccgcaacgagcgcaacccctatctttagtagccagcattttggatgggcactctagagagactgccagggataacctggaggaaggtggggatgacgtcaaatcatcatgccccttatgatcagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 253 - DNA, 1242 bp, Ruminococcus gnavus
  misc_feature (1)..(1): n is a, c, g, or t
ncgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggaactttccttcgggacagaggagacaggtggtgcatggttgtcgtcagctcgtgtcgtgagatgttgggttaagtcccgcaacgagcgcaacccctatctttagtagccagcattttggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 254 - DNA, 1528 bp, Ruminococcus gnavus
aacgagagtttgatcctggctcaggatgaacgctggcggcgtgcttaacacatgcaagtcgagcgaagcaccttgacggatttcttcggattgaagccttggtgactgagcggcggacgggtgagtaacgcgtgggtaacctgcctcatacagggggataacagttggaaacggctgctaataccgcataagcgcacagtaccgcatggtacggtgtgaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggaaagcggaattcctagtgtagcggtgaaatgcgtagatattaggaggaacaccagtggcgaaggcggctttctggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctctgaccgctctttaatcggagctttccttcgggacagaggagacaggtggtgcatggttgtcgtcagctcgtgtcgtgagatgttgggttaagtcccgcaacgagcgcaacccctatctttagtagccagcatttcggatgggcactctagagagactgccagggataacctggaggaaggtggggatgacgtcaaatcatcatgccccttatgaccagggctacacacgtgctacaatggcgtaaacaaagggaagcgagcccgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctccttt

SEQ ID NO: 255 - DNA, 1372 bp, Blautia_wexlerae
tcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccggg

SEQ ID NO: 256 - DNA, 1305 bp, Gemmiger_formicilis
aaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgccagcagccgcggtaaaacgtagggtgcaagcgttgtccggaattactgggtgtaaagggagcgcaggcggaccggcaagttggaagtgaaatccatgggctcaacccgtgaattgctttcaaaactgctggccttgagtagtgcagaggtaggtggaattcccggtgtagcggtggaatgcgtagatatcgggaggaacaccagtggcgaaggcgacctactgggcaccaactgacgctgaggctcgaaagcatgggtagcaaacaggattagataccctggtagtccatgccgtaaacgatgattactaggtgttggaggattgaccccttcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagtgcagagatgcatgaagtccttcgggacatcgagacaggtggtgcatggttgtcgtcagctcgtgtcgtgagatgttgggttaagtcccgcaacgagcgcaacccttattgccagttactacgcaagaggactctggcgagactgccgttgacaaaacggaggaaggtggggatgacgtcaaatcatcatgccctttatgacctgggctacacacgtactacaatggcgtttaacaaagagaagcaagaccgcgaggtggagcaaaactcagaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtatcggaaggtgcggctggatcacctccttt

SEQ ID NO: 257 - DNA, 1518 bp, Eisenbergiella_massiliensis
agagagtttgatcctggctcaggatgaacgctggcggcgtgcctaacacatgcaagtcgaacggagttatgcagaggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgtccgtaacggggcattctcttcggagcattggagacaggtggtgcatggttgtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgcaagggaggagcagtcgaaggcaggtctaataactggggtgaagtcgtaacaaggtagccgtatcggaaggtgcggctggatg

SEQ ID NO: 258 - DNA, 1511 bp, Ruminococcus_sp.
ctaaagagtttgatcctggctcaggacgaacgctggcggcgcgcctaacacatgcaagtcgaacggagaaatgctgagcttgctttgcatttcttagtggcggacgggtgagtaacacgtgagcaacctgcctttgtgaggggaataacgtctggaaacggacgctaataccgcataacgtcaaggaaccgcatggttttttgaccaaagattttatcgcacaaagatgggctcgcggctgattagctagttggcggggtaacggcccaccaaggcgacgatcagtagccggactgagaggttgatcggccacattgggactgagacacggcccagactcctacgggaggcagcagtgggggatattgcacaatgggggaaaccctgatgcagcgacgccgcgtgagggaagacggttttcggattgtaaacctctgtcttcagggacgaaatcaatgacggtacctgaggaggaagccacggctaactacgtgccagcagccgcggtaatacgtaggtggcaagcgttgtccggaattactgggtgtaaagggagcgtaggcgggaatgcaagttgaatgtttaaactatcggctcaactgataatcgcgttcaaaactgcatttcttgagtggagtagaggcaggcggaattcctagtgtagcggtgaaatgcgtagatattaggaggaacaccagtggcgaaggcggcctgctgggctctaactgacgctgaggctcgaaagcgtgggtagcaaacaggattagataccctggtagtccacgccgtaaacgatgattactaggtgtggggggactgaccccttccgtgccggagttaacacaataagtaatccacctggggagtacggtcgcaagactgaaactcaaaggaattgacgggggcccgcacaagcagtggagtatgtggtttaattcgaagcaacgcgaagaaccttaccaggtcttgacatcgtgcgcataccgtagagatacgggaagtccttcgggacgcatagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcacttaacagagggaagcaagaccgcgaggtggagcaaacccccaaaaagtgtctcagttcggattgcaggctgcaacccgcctgtatgaagtcggaattgctagtaatcgcggatcagcatgccgcggtgaatacgttcccgggccttgtacacaccgcccgtcacaccatgagagccggtaacacccgaagtcagtagcctaaccgcaaggagggcgctgccgaaggtgggattggtgattagggtgaagtcgtaacaaggtagccgtatcggaaggtgcggctggatcacctccttt

SEQ ID NO: 259 - DNA, 1530 bp, Roseburia_faecis
atgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggattgcatgatccggtgtgaaaaactccggtggtatgggatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcaggaaagaaaaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtactttctcttcggagcatcggtgacaggtggtgcatggttgtcgtcagctcgtgtcgtgagatgttgggttaagtcccgcaacgagcgcaacccctgttcttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctccttt

SEQ ID NO: 260 - DNA, 1521 bp, Butyrivibrio_sp.
ttgagagtttgatcctggctcaggatgaacgctggcggcgtgcttaacacatgcaagtcgaacggacggattggagcttgctccatgaagttagtggcggacgggtgagtaacgcgtgggtaacctgccctatgcagggggataacgtttggaaacgaacgctaataccgcataacctagttggttcgcatgaaccgactagcaaagattttatcggcataggatggacccgcgttggattagctagttggtgagataacagcccaccaaggcaacgatccatagccggcctgagagggtgaacggccacactgggactgagacacggcccagactcctacgggaggcagcagtggggaatattgcacaatgggcgcaagcctgatgcagcgacgccgcgtgaaggatgaaggtcttcggatcgtaaacttctatcagcagggaagaaaccatgacggtacctgactaagaagccccggctaactacgtgccagcagccgcggtaatacgtagggggcaagcgttatccggaattactgggtgtaaagggtgcgtaggcggcgatttaagtcagatgtgaaaactcagggctcaaccttgagactgcatctgaaactgagttgctagagtgcaggagaggaaagcggaattccgagtgtagcggtgaaatgcgtagagattcggaggaacaccagtagcgaaggcggctttctggactgtaactgacgctgaggcacgaaagcgtggggagcgaacaggattagataccctggtagtccacgccgtaaacgatgaatactaggtgtcggggcttacgggtctcggtgccgcagctaacgcattaagtattccacctgggaagtacgaccgcaaggttgaaactcaaaggaattgacggggacccgcacaagcggtggagcatgtggtttaattcgaagcaacgcgaagaaccttacctaaacttgacatccctttgaccggtccttaatcggatctttactagcttgctagtacaaaggtgacaggtggtgcatggttgtcgtcagctcgtgtcgtgagatgttgggttaagtcccgcaacgagcgcaacccctatctttagtagccatcattcagttgggcactctagagagactgccagggataacctggaggaaggtggggatgacgtcaaatcatcatgccccttatgtttagggctacacacgtgctacaatgggtgctacaaagggaagcaaatccgcgaggccgagcaaatctcaaaaaagcactcccagttcggattgtagtctgcaactcgactacatgaagttggaatcgctagtaatcgcgaatcagaatgtcgcggtgaatacgttcccgggtcttgtacacaccgcccgtcacaccatgggagttgggggggcccaacgccagtgacctaacccgcaagggaaggagctgtctaaggcaaaaccaatgactggggtgaagtcgtaacaaggtagccgtatcggaaggtgcggctggatcacctccttt

SEQ ID NO: 261 - DNA, 1529 bp, Blautia_sp_CAG_257
acagagagtttgatcctggctcaggatgaacgctggcggcgtgcttaacacatgcaagtcgaacggggattattttgacagagacttcggttgaagtcgttataatcctagtggcggacgggtgagtaacgcgtgggtaacctgcctcacactgggggataacagtcagaaatgactgctaataccgcataagcgcacagagctgcatggctcagtgtgaaaaactccggtggtgtgagatggacccgcgttggattagccagttggcagggtaacggcctaccaaagcgacgatccatagccggcctgagagggtggacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaggcgggggctcaacccccggactgcattggaaactgttgatcttgagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccggtgagtaacgtcacctttccttcgggacagaggagacaggtggtgcatggttgtcgtcagctcgtgtcgtgagatgttgggttaagtcccgcaacgagcgcaacccctatccttagtagccagcggtttggccgggcactctgaggagactgccagggataacctggaggaaggcggggatgacgtcaaatcatcatgccccttatgatttgggctacacacgtgctacaatggcgtaaacaaagggaagcgagagtgtgagcttaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgaccgaaccgaaaggacggagctgccgaaggcgggacggatgactggggtgaagtcgtaacaaggtagccgtatcggaaggtgcggctggatcacctccttt

SEQ ID NO: 262 - DNA, 1210 bp, Eubacterium_sp_3_1_31
gaacggccacattgggactgagacacggcccagactcctacgggaggcagcagtggggaatattgcgcaatgggggaaaccctgacgcagcaacgccgcgtgattgaagaaggccttcgggttgtaaagatctttaattggggacgaaaaatgacggtacccaaagaataagctccggctaactacgtgccagcagccgcggtaatacgtagggagcaagcgttatccggatttactgggtgtaaagggcgagtaggcgggctggcaagttgggagtgaaatcccggggcttaaccccggaactgctttcaaaactgctggtcttgagtgatggagaggcaggcggaattccgtgtgtagcggtgaaatgcgtagatatacggaggaacaccagtggcgaaggcggcctgctggacattaactgacgctgaggagcgaaagcgtggggagcaaacaggattagataccctggtagtccacgccgtaaacgatggatactaggtgtgggaggtattgaccccttccgtgccggagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatccctctgaccgccctagagatagggtttcccttcggggcagaggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaacagtgatgtggagcaaatccctaaaagctgtcccagttcagattgcaggctgcaactcgcctgcatgaagtcggaattgctagtaatcgcggatcagcatgccgcggtgaatacgttcccgggccttgtacacaccgcccgtcacaccatgagagccggtaatacccgaagtccgtagcctaaccgcaaggagggcgcggccgaaggtaggactggtaattagggtgaagtcgtaacaaggtagccgtatcggaaggtgcggctggatcacctccttt

SEQ ID NO: 263 - DNA, 1307 bp, Gemmiger_formicilis
aaaaggatttattcgctttaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgccagcagccgcggtaaaacgtagggtgcaagcgttgtccggaattactgggtgtaaagggagcgcaggcgggaagacaagttggaagtgaaaaccatgggctcaacccatgaattgctttcaaaactgtttttcttgagtagtgcagaggtagatggaattcccggtgtagcggtggaatgcgtagatatcgggaggaacaccagtggcgaaggcggtctactgggcaccaactgacgctgaggctcgaaagcatgggtagcaaacaggattagataccctggtagtccatgccgtaaacgatgattactaggtgttgggggattgaccccctcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagcacagagatgtgtgaaatccttcgggacatcgagacaggtggtgcatggttgtcgtcagctcgtgtcgtgagatgttgggttaagtcccgcaacgagcgcaacccttattgccagttactacgttaagaggactctggcgagactgccgttgacaaaacggaggaaggtggggatgacgtcaaatcatcatgccctttatgacctgggctacacacgtactacaatggcgttaaacaaagagaagcaagaccgcgaggtggagcaaaactcaaaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccggggggacccgaagtcgatagtctaaccgcaaggaggacgtcgccgaaggtaaaactggtgattggggtgaagtcgtaacaaggtagccgtatcggaaggtgcggctggatcacctccttt

SEQ ID NO: 264 - DNA, 1253 bp, Intestinimonas_butyriciproducens
ggctcaccaaggcgacgatcagtagccggactgagaggttggccggccacattgggactgagacacggcccagactcctacgggaggcagcagtggggaatattgggcaatgggcgaaagcctgacccagcaacgccgcgtgaaggaagaaggccctcgggttgtaaacttcttttgtcagggacgaagcaagtgacggtacctgacgaataagccacggctaactacgtgccagcagccgcggtaatacgtaggtggcaagcgttatccggatttactgggtgtaaagggcgtgtaggcgggagtgcaagtcagatgtgaaaactatgggctcaacccatagcctgcatttgaaactgtacttcttgagtgatggagaggcaggcggaattccctgtgtagcggtgaaatgcgtagatatagggaggaacaccagtggcgaaggcggcctgctggacattaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccaggacttgacatcctactaacgaagcagagatgcataaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggcggtcaacagagggaagcaaagccgcgaggtggagcaaatccctaaaagccgtcccagttcggattgcaggctgaaactcgcctgtatgaagtcggaatcgctagtaatcgcggatcagcatgccgcggtgaatacgttcccgggccttgtacacaccgcccgtcacaccatgagagtcgggaacacccgaagtccgtagcctaacagcaatgggggcgcggccgaaggtgggttcgataattggggtgaagtcgtaacaaggtagccgtatcggaaggtgcggctggatcacctccttt

SEQ ID NO: 265 - DNA, 1529 bp, Oscillospiraceae_bacterium_VE202_24
tatagagagtttgatcctggctcaggacgaacgctggcggcgtgcttaacacatgcaagtcgaacggagcacccttgactgaggtttcggccaaatgataggaatgcttagtggcggactggtgagtaacgcgtgaggaacctaccttccagagggggacaacagttggaaacgactgctaataccgcatgacgcatgaccggggcatcccgggcatgtcaaagattttatcgctggaagatggcctcgcgtctgattagctagatggtggggtaacggcccaccatggcgacgatcagtagccggactgagaggttgaccggccacattgggactgagatacggcccagactcctacgggaggcagcagtggggaatattgggcaatggacgcaagtctgacccagcaacgccgcgtgaaggaagaaggctttcgggttgtaaacttcttttgtcagggaagagtagaagacggtacctgacgaataagccacggctaactacgtgccagcagccgcggtaatacgtaggtggcaagcgttgtccggatttactgggtgtaaagggcgtgcagccgggccggcaagtcagatgtgaaatctggaggcttaacctccaaactgcatttgaaactgtaggtcttgagtaccggagaggttatcggaattccttgtgtagcggtgaaatgcgtagatataaggaagaacaccagtggcgaaggcggataactggacggcaactgacggtgaggcgcgaaagcgtggggagcaaacaggattagataccctggtagtccacgctgtaaacgatggatactaggtgtgcggggactgaccccctgcgtgccgcagttaacacaataagtatcccacctggggagtacgatcgcaaggttgaaactcaaaggaattgacgggggcccgcacaagcggtggattatgtggtttaattcgaagcaacgcgaagaaccttaccagggcttgacatcctactaacgaagtagagatacatcaggtgcccttcggggaaagtagagacaggtggtgcatggttgtcgtcagctcgtgtcgtgagatgttgggttaagtcccgcaacgagcgcaacccctattgttagttgctacgcaagagcactctagcgagactgccgttgacaaaacggaggaaggtggggacgacgtcaaatcatcatgccccttatgtcctgggctacacacgtaatacaatggcggtcaacagagggaggcaaagccgcgaggcagagcaaacccccaaaagccgtcccagttcggatcgcaggctgcaacccgcctgcgtgaagtcggaatcgctagtaatcgcggatcagcatgccgcggtgaatacgttcccgggccttgtacacaccgcccgtcacaccatgagagtcgggaacacccgaagtccgtagcctaaccgcaaggagggcgcggccgaaggtgggttcgataattggggtgaagtcgtaacaaggtagccgtatcggaaggtgcggctggatcacctccttt

SEQ ID NO: 266 - DNA, 1420 bp, Clostridium_sp_CAG_91
tagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtagaactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtacgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaaccgcaaggaaggagccgccgaaggcaggtctgataactggggtgaagtcgtaacaaggtagccgtatcggaaggtgcggctggatcacctccttt

SEQ ID NO: 267 - DNA, 1177 bp, Ruminococcus obeum
cctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatccccagtagccagcggttcggccgggcactctgaggagactgccagggataacctggaggaaggcggggatgacgtcaaatcatcatgccccttatgatttgggctacacacgtgctacaatggcgtaaacaaagggaagcaagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgcaagggaggagctgccgaaggcgggaccgatgactggggtgaagtcgtaacaaggtagccgtatcggaaggtgcggctggatcacctccttt

SEQ ID NO: 268 - DNA, 1526 bp, Blautia_sp.
atgagagtttgatcctggctcaggatgaacgctggcggcgtgcttaacacatgcaagtcgagcgaagcaatttaagtgaagttttcggatggatcttagattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctggggagactgccagggataacctggaggaaggtggggatgacgtcaaatcatcatgccccttatgatttgggctacacacgtgctacaatggcgtaaacaaagggaagcaagagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctccttt

SEQ ID NO: 269 - DNA, 1526 bp, Blautia_sp.
atgagagtttgatcctggctcaggatgaacgctggcggcgtgcttaacacatgcaagtcgagcgaagcaatttaagtgaagttttcggatggatcttagattgactgagcggcggacgggtgagtaacgcgtggataacctgcctcacacagggggataacagttagaaatgactgctaataccgcataagcgcacggtaccgcatggtacagtgtgaaaaactccggtggtgtgagatggatccgcgtctgattaggtagttggtgaggtaacggcccaccaagccgacgatcagtagccgacctgagagggtgaccggccacattgggactgagacacggcccaaactcctacgggaggcagcagtggggaatattgcacaatgggcgaaagcctgatgcagcaacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcactgcaagtctgaagtgaaagcccggggctcaaccccgggactgctttggaaactgtagagctagagtgctggagaggcaagcggaattcctagtgtagcggtgaaatgcgtagatattaggaagaacaccagtggcgaaggcggcttgctggacagtaactgacgttcaggctcgaaagcgtggggagcaaacaggattagataccctggtagtccacgccgtaaacgatgaatactaggtgttggtgggcaaagcccatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgtgatgaccggaacttaaccgttccttcccttcggggcatcatagacaggtggtgcatggttgtcgtcagctcgtgtcgtgagatgttgggttaagtcccgcaacgagcgcaacccttatcctcagtagccagcagtaagatgggcactctgtggagactgccagggataacctggaggaaggtggggatgacgtcaaatcatcatgccccttatgatttgggctacacacgtgctacaatggcgtaaacaaagggaagcaagagggtgacctggagcaaatcccaaaaataacgtcccagttcggactgtagtctgcaacccgactacacgaagctggaatcgctagtaatcgcagatcagaatgctgcggtgaatacgttcccgggtcttgtacacaccgcccgtcacaccatgggagtcagcaacgcccgaagtcagtgactcaaccgcaaggagagagctgccgaaggcggggcaggtaactggggtgaagtcgtaacaaggtagccgtatcggaaggtgcggctggatcacctccttt

SEQ ID NO: 270 - DNA, 1530 bp, Lachnospira pectinoschiza
ttatgagagtttgatcctggctcaggatgaacgctggcggcgtgcttaacacatgcaagtcgaacgaagcatttgcgacagatttcttcggattgaagttgcttatgactgagtggcggacgggtgagtaacgcgtgggtaacctgcctcacacagggggatagcagttggaaacggctgataataccgcataagcgcacagtaccgcatggtacagtgtgaaaaactccggtggtgtgagatggacccgcgtctgattagcttgttggcagggtaacggcctaccaaggcaacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggcatcacaagtcagaagtgaaagcccggggctcaaccccgggactgcttttgaaactgtggagctggagtgcaggagaggcaagtggaattcctagtgtagcggtgaaatgcgtagatattaggaggaacaccagtggcgaaggcggcttgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctcttgcccggtcagtaatgtgaccttttcttcggaacaagagtgacaggtggtgcatggttgtcgtcagctcgtgtcgtgagatgttgggttaagtcccgcaacgagcgcaacccctattcttagtagccagcatttaaggtgggcactctaggaagactgccagggataacctggaggaaggtggggatgacgtcaaatcatcatgccccttatgacttgggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaacgaaagaaggagccgccgaaggcaggtctgataactggggtgaagtcgtaacaaggtagccgtatcggaaggtgcggctggatcacctccttt

SEQ ID NO: 271 - DNA, 1226 bp, Lactonifactor_longoviformis
ctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatactaggtgtcgggcgccaaaggcgttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccggtccgtaacaggacccttccttcgggacaggcaagacaggtggtgcatggttgtcgtcagctcgtgtcgtgagatgttgggttaagtcccgcaacgagcgcaacccttatccttagtagccagcaggtagagctgggcactctagggagactgccagggacaacctggaggaaggtggggatgacgtcaaatcatcatgccccttatgatttgggctacacacgtgctacaatggcgtaaacaaagggaggcgaaggggtgacctggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggatatgcccgaagccggtgaccgaacccgaaagggaaggagccgtcgaaggtggagccgataactggggtgaagtcgtaacaaggtagccgtatcggaaggtgcggctggatcacctccttt

SEQ ID NO: 272 - DNA, 1530 bp, Eubacterium contortum
aacgagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggataacagttagaaatgactgctaataccgcataagaccacagtaccgcatggtaccgtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 273 - DNA, 1530 bp, Eubacterium contortum
aacgagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggacaacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 274 - DNA, 1530 bp, Eubacterium contortum
aacgagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 275 - DNA, 1530 bp, Eubacterium contortum
aacgagagtttgatcctggctcaggatgaacgctggcggcgtgcttaacacatgcaagtcgagcgaagcactttacttagatttcttcggaatgaagagtgttgtgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 276 - DNA, 884 bp, Eisenbergiella_tayi
ggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatctcgtaaaagggataggccttcgggacaggggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctccttt

SEQ ID NO: 277 - DNA, 1528 bp, Ruminococcus_gnavus_sp
aacgagagtttgatcctggctcaggatgaacgctggcggcgtgcttaacacatgcaagtcgagcgaagcgcttttgcggatttcttcggattgaagcaactgtgactgagcggcggacgggtgagtaacgcgtgggtaacctgcctcatacagggggataacagttggaaacggctgctaataccgcataagcgcacagtaccgcatggtaccgtgtgaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaagcccggggctcaaccccgggactgcatttggaactgtcaggctagagtgtcggagaggtaagcggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctggtcttgacatccctatgaccgctctttaatcggagctttccttcgggacagaggagacaggtggtgcatggttgtcgtcagctcgtgtcgtgagatgttgggttaagtcccgcaacgagcgcaacccctatctttagtagccagcattttggatgggcactctagagagactgccagggataacctggaggaaggtggggatgacgtcaaatcatcatgccccttatgaccagggctacacacgtgctacaatggcgtaaacaaagggaagcgaacctgcgagggggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctccttt

SEQ ID NO: 278 - DNA, 1531 bp, Clostridium_aldenense_sp
tttgagagtttgatcctggctcaggatgaacgctggcggcgtgcctaacacatgcaagtcgaacgaagcgattaggatgaagttttcggatggattcctggttgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcggaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctggagtgaaagcccggggcccaaccccgggactgctttggaaactgtgctgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccttcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggcgcgtaacggtgcccttccttcgggacaggggagacaggtggtgcatggttgtcgtcagctcgtgtcgtgagatgttgggttaagtcccgcaacgagcgcaacccttatccttagtagccagcacgtcgtggtgggcactctagggagactgccagggataacctggaggaaggtggggatgacgtcaaatcatcatgccccttatgatttgggctacacacgtgctacaatggcgtaaacaaagggaggcgaccctgcgaaggtaagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgacccaaccttaacaggagggagctgccgaaggcggggcaggtaactggggtgaagtcgtaacaaggtagccgtatcggaaggtgcggctggatcacctccttt

SEQ ID NO: 279 - DNA, 1531 bp, Clostridium_sp
acgagagtttgatcctggctcaggacgaacgctggcggcgtgcctaacacatgcaagtcgaacgagaatctttgaacagatcttttcggagtgacgttcaaagaggaaagtggcggacgggcgagtaacgcgtgagtaacctgcccataagagggggataatccatggaaacgtggactaataccgcatattgtagttaagttgcatgacttgattatgaaagatttatcgcttatggatggactcgcgtcagattagatagttggtgaggtaacggctcaccaagtcaacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtcttcggattgtaaactgttgtcgcaagggaagaagacagtgacggtaccttgtgagaaagtcacggctaactacgtgccagcagccgcggtaatacgtaggtgacaagcgttgtccggatttactgggtgtaaagggcgcgtaggcggactgtcaagtcagtcgtgaaataccggggcttaaccccggggctgcgattgaaactgacagccttgagtatcggagaggaaagcggaattcctagtgtagcggtgaaatgcgtagatattaggaggaacaccagtggcgaaggcggctttctggacgacaactgacgctgaggcgcgaaagtgtggggagcaaacaggattagataccctggtagtccacaccgtaaacgatggatactaggtgtaggaggtatcgaccccttctgtgccgcagttaacacaataagtatcccacctggggagtacgaccgcaaggttgaaactcaaaggaattgacgggggcccgcacaagcagtggagtatgtggtttaattcgaagcaacgcgaagaaccttacctgggcttgacatccctggaatcgagtagagatacttgagtgccttcgggaatcaggtgacaggtggtgcatggttgtcgtcagctcgtgtcgtgagatgttgggttaagtcccgcaacgagcgcaacccctattgtcagttgccatcattaagttgggcactctggcgagactgccggtgacaaatcggaggaaggtggggacgacgtcaaatcatcatgccccttatgcccagggctacacacgtactacaatggccgataacaaagtgcagcgaaaccgtgaggtggagcgaatcacaaaactcggtctcagttcagattgcaggctgcaactcgcctgcatgaagttggaattgctagtaatcgcggatcagaatgccgcggtgaatacgttcccgggccttgtacacaccgcccgtcacaccatgagagtcgataacacccgaagcctgtgagctaacctttaggaggcagcagtcgaaggtggggttgatgattggggtgaagtcgtaacaaggtagccgtatcggaaggtgcggctggatcacctccttt

SEQ ID NO: 280 - DNA, 1529 bp, Clostridium_lavalense
tttgagagtttgatcctggctcaggatgaacgctggcggcgtgcctaacacatgcaagtcgaacgaagcatttcagatgaagttttcggatggattctgagatgactgagtggcggacgggtgagtaacacgtggataacctgcctcacactgggggacaacagttagaaatgactgctaataccgcataagcgcacagtaccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagggagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctccttt

SEQ ID NO: 281 - DNA, 1493 bp, Blautia_producta
agagtttgatcctggctcaggatgaacgctggcggcgtgcttaacacatgcaagtcgagcgaagcactaagacggatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacggggacttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtaacc

SEQ ID NO: 282 - DNA, 1524 bp, Clostridium nexile
  misc_feature (1)..(7): n is a, c, g, or t
  misc_feature (191)..(192): n is a, c, g, or t
  misc_feature (348)..(348): n is a, c, g, or t
  misc_feature (437)..(437): n is a, c, g, or t
nnnnnnngagatttgatcctggctcaggatgaacgctggccggccgtgcttacacatgcagtcgaacgaagcgcttaaactggatttcttcggattgaagtttttgctgactgagtggcggacgggtgagtaacgcgtgggtaacctgcctcatacagggggataacagttagaaatgactgctaataccnnataagcgcacagtgctgcatggcacagtgtaaaaactccggtggtatgagatggacccgcgtctgattagctagttggtggggtaacggcctaccaaggcgacgatcagtagccggcctgagagggtgaacggccacattgggactgagacacggnccaaactcctacgggaggcagcagtggggaatattgcacaatgggggaaaccctgatgcagcgacgccgcgtgagcgaagaagtatttnggtatgtaaagctctatcagcagggaagaaaatgacggtacctgactaagaagcaccggctaaatacgtgccagcagccgcggtaatacgtaggtgcaagcgttatccggatttactgggtgtaaagggagcgtagacggttgtgtaagtctgatgtgaaagcccggggctcaaccccggactgcattggaaactatgtaactagagtgtcggagaggtaagcggaattcctagtgtagcggtgaaatgcgtagatattaggaggaacaccagtggcgaaggcggcttactggacgatcactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcgtggagcatgtggtttaattcgagcaacgcgaagaccttacctggtcttgacatcccggtgaccggtccagtaatgggacctttccttcgggacacggtgacaggtggtgcatggttgtcgtcagctcgtgtcgtgagatgttgggttaagtcccgcaacgagcgcaacccctatcttcagtagccagcatttaaggtgggcactctggagagactgccagggataacctggaggaaggtggggatgacgtcaaatcatcatgccccttatgaccagggctacacacgtgctacaatggcgtaaacaaagggaagcgaacctgtgaggggaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcc

SEQ ID NO: 283 - DNA, 1454 bp, Roseburia_inulinivorans
ttgatcctggctcaggatgaacgctggcggcgtgcttaacacatgcaagtcgaacgaagcacttttacagatttcttcggaatgaagttttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcacagcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggacagtaatgtgtcctttccttcgggacagaagtgacaggtggtgcatggttgtcgtcagctcgtgtcgtgagatgttgggttaagtcccgcaacgagcgcaacccttatccccagtagccagcggttcggacgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgcgaaggcaggt

SEQ ID NO: 284 - DNA, 1329 bp, Streptococcus_infantis
gaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcracgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgaagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattyagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaac

SEQ ID NO: 285 - DNA, 1338 bp, Streptococcus_infantis
  misc_feature (716)..(716): n is a, c, g, or t
tgcctaatacatgcaagtagaacgctgaaggaggagcttgctcttctggatgagttgcgaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgngaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacg

SEQ ID NO: 286 - DNA, 1462 bp, Streptococcus_infantis
gacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgaagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgatt

SEQ ID NO: 287 - DNA, 1354 bp, Clostridium_sp_CL_6
gcgatgaagcccttcggggtggattagcggcggacgggtgagtaacacgtgggtaacctgccttgtagagggggatagccttccgaaaggaagattaataccgcataacatctttttatcgcatggtagaaagatcaaaggagcaatccgctacaagatggacccgcggcgcattagctagttggtgaggtaacggctcaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgtttacggggacgataatgacggtacccgtggggaagccacggctaactacgtgccagcagccgcggtaatacgtaggtggcaagcgttgtccggatttactgggcgtaaaggatgcgtaggcggatgtttaagtgagatgtgaaatacccgggctcaacttgggtgctgcatttcaaactggacatctagagtgcgggagaggaaagcggaattcctagtgtagcggtgaaatgcgtagagattaggaagaacaccagtggcgaaggcggctttctggaccgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacgatcgcaagattaaaactcaaaggaattgacgggggcccgcacaagcagcggagcatgtggtttaattcgaagcaacgcgaagaaccttacctagacttgacatctcctgaattactcttaatcgaggaagcccttcggggcaggaagacaggtggtgcatggttgtcgtcagctcgtgtcgtgagatgttgggttaagtcccgcaacgagcgcaacccttatcattagttgctaccattaagttgagcactctagtgagactgccacggttaacgtggaggaaggtggggatgacgtcaaatcatcatgccccttatgtctagggctacacacgtgctacaatggtgaatacaaatagatgcaataccgcgaggtggagccaaactataaaattcatcccagttcggattgcagtctgaaactcgactgcatgaagccggagttgctagtaatcgcgaatcagcatgtcgcggtgaatacgttcccgggccttgtacacaccgcccgtcacaccatgagagctggtaacacccgaagttccgtgaggtaaccgca

SEQ ID NO: 288 - DNA, 1542 bp, Streptococcus_mitis_oralis_pneumoniae
aatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtggatgttgcatgacatttgcttaaaaggtgcacttgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgctgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctt

SEQ ID NO: 289 - DNA, 1542 bp, Streptococcus_mitis_oralis_pneumoniae; identical to SEQ ID NO: 288

SEQ ID NO: 290 - DNA, 1542 bp, Streptococcus_mitis_oralis_pneumoniae; identical to SEQ ID NO: 288

SEQ ID NO: 291 - DNA, 1542 bp, Streptococcus_mitis_oralis_pneumoniae; identical to SEQ ID NO: 288

SEQ ID NO: 292 - DNA, 1539 bp, Proteus mirabilis
ttgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 293 - DNA, 1539 bp, Proteus mirabilis
ttgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttgtcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 294 - DNA, 1539 bp, Proteus mirabilis; identical to SEQ ID NO: 292

SEQ ID NO: 295 - DNA, 1539 bp, Proteus mirabilis
ttgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 296 - DNA, 1539 bp, Proteus mirabilis; identical to SEQ ID NO: 293

SEQ ID NO: 297 - DNA, 1539 bp, Proteus mirabilis
ttgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttctggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 298 - DNA, 1539 bp, Proteus mirabilis; identical to SEQ ID NO: 297

SEQ ID NO: 299 - DNA, 1572 bp, Pediococcus acidilactici
atgagagtttgatcttggctcaggatgaacgctggcggcgtgcctaatacatgcaagtcgaacgaacttccgttaattgatcaggacgtgcttgcactgaatgagattttaacacgaagtgagtggcggacgggtgagtaacacgtgggtaacctgcccagaagcaggggataacacctggaaacagatgctaataccgtataacagagaaaaccgcctggttttcttttaaaagatggctctgctatcacttctggatggacccgcggcgcattagctagttggtgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggatggtacaacgagttgcgaaaccgcgaggtttagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctt

SEQ ID NO: 300 - DNA, 1528 bp, Bifidobacterium dentium
tatggagggttcgattctggctcaggatgaacgctggcggcgtgcttaacacatgcaagtcgaacgggatcccgggggttcgctcccgggtgagagtggcgaacgggtgagtaatgcgtgaccgacctgccccatacaccggaatagctcctggaaacgggtggtaatgccggatgctccggttggatgcatgtccttccgggaaagattccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaaccccttgcgggatggagccgtctaaggtgaggctcgtgattgggactaagtcgtaacaaggtagccgtaccggaaggtgcggctggatcacctccttt

SEQ ID NO: 301 - DNA, 1540 bp, Proteus_penneri
ttgaagagtttgatcatggctcagattgaacgctggcggcaggcctaacacatgcaagtcgagcggtaacagaagaaagcttgctttcttgctgacgagcggcggacgggtgagtaatgtatggggatctgcccgatagagggggagtaactactggaaacggtggctaataccgcatgacgtctacggaccaaagcaggggctcttcggaccttgcgctatcggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatctgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcggatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 302 - DNA, 1381 bp, Proteus_penneri
ttgaagagtttgatcatggctcagattgaacgctggcggcaggcctaacgcatgcaagtcgaccggaaacagaggaaagcttgctttcttgctgacgagcggcggacgggtgagtaatgtatggggatctgcccgatagaggggggtaactattggaaaaagggggggtaaataccgcttgacgtctacggccaaaagccggggcgcttcggacctttcgctattggatgaacccatatgggattagctagtaggtgaggtaaaggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaagttaatacctttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagagggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacg

SEQ ID NO: 303 - DNA, 1040 bp, Lactobacillus salivarius
  misc_feature (1039)..(1040): n is a, c, g, or t
atgagagtttgatcctggctcaggacgaacgctggcggcgtgcctaatacatgcaagtcgaacgaaactttcttacaccgaatgcttgcattcatcgtaagaagttgagtggcggacgggtgagtaacacgtgggtaacctgcctaaaagaaggggataacacttggaaacaggtgctaataccgtatatctctaaggatcgcatgatccttagatgaaagatggttctgctatcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattcgatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggnn

SEQ ID NO: 304 - DNA, 1560 bp, Veillonella dispar
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggattacctccttt

SEQ ID NO: 305 - DNA, 1560 bp, Veillonella dispar
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctccttt

SEQ ID NO: 306 - DNA, 1560 bp, Veillonella dispar
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctccttt

SEQ ID NO: 307 - DNA, 1524 bp, Rothia dentocariosa
acggagagtttgattctggctcaggacgaacgctggcggcgtgcttaacacatgcaagtcgaacgatgaagcctagcttgctaggtggattagtggcgaacgggtgagtaatacgtgagtgacctacctttgactctgggataagcctgggaaactgggtctaataccggatacgaccaatctccgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggctggggcttaaccctggttttgcagtgggtacgggctaactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggactgcgtcagagatggcgtttcccttcggggctggtatacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccctggtggggggagccgtcgaaggtgggactggcgattgggactaagtcgtaacaaggtagccgtaccggaaggtgcggctggatcacctccttt

SEQ ID NO: 308 - DNA, 1524 bp, Rothia dentocariosa; identical to SEQ ID NO: 307

SEQ ID NO: 309 - DNA, 1524 bp, Rothia dentocariosa; identical to SEQ ID NO: 307

SEQ ID NO: 310 - DNA, 1555 bp, Megasphaera_micronuciformis
atggagagtttgatcctggctcaggacgaacgctggcggcgtgcttaacacatgcaagtcgaacgagagcgtagagaaagcttgctttttctacaatctagtggcaaacgggtgagtaacgcgtaaacaacctgccctacggatggggacaacagctggaaacggctgctaataccgaatacgttccgaaagtcgcatgactgtcggaagaaaggatggcctctatttataagctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaataatcttgtggttaatacccataagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctcagagtatcggagaggaaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaacggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctgg

SEQ ID NO: 311 - DNA, 1560 bp, Veillonella atypica
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctccttt

SEQ ID NO: 312 - DNA, 1544 bp, Streptococcus thermophilus; identical to SEQ ID NO: 128

SEQ ID NO: 313 - DNA, 1543 bp, Streptococcus thermophilus; identical to SEQ ID NO: 129

SEQ ID NO: 314 - DNA, 1544 bp, Streptococcus thermophilus; identical to SEQ ID NO: 130

SEQ ID NO: 315 - DNA, 1543 bp, Streptococcus thermophilus; identical to SEQ ID NO: 131

SEQ ID NO: 316 - DNA, 1543 bp, Streptococcus thermophilus; identical to SEQ ID NO: 132

SEQ ID NO: 317 - DNA, 1561 bp, Lactobacillus animalis
attgagagtttgatcctggctcaggatgaacgctggcggcgtgcctaatacatgcaagtcgaacgaaacttctttatcaccgagtgcttgcactcaccgataaagagttgagtggcgaacgggtgagtaacacgtgggcaacctgcccaaaagagggggataacacttggaaacaggtgctaataccgcataaccatagttaccgcatggtaactatgtaaaaggtggctatgctaccgcttttggatgggcccgcggcgcattagctagttggtgaggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaatcctagagataggactttcccttcggggacagaatgacaggtggtgcatggttgtcgtcagctcgtgtcgtgagatgttgggttaagtcccgcaacgagcgcaacccttattgttagttgccagcattaagttgggcactctagcaagactgccggtgacaaaccggaggaaggtggggatgacgtcaaatcatcatgccccttatgacctgggctacacacgtgctacaatggacggtacaacgagtcgcaagaccgcgaggtttagcaaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtggggtaaccttttggagccagccgtctaaggtgggacagatgattggggtgaagtcgtaacaaggtagccgtaggagaacctgcggctggatcacctccttt

SEQ ID NO: 318 - DNA, 1548 bp, Bilophila wadsworthia
ctggagagtttgattctggctcagattgaacgctggcggcgtgcttaacacatgcaagtcgaacgtgaaagtccttcggggcgagtaaagtggcgcacgggtgagtaacgcgtggataatctacccttaagatggggataacggctggaaacggtcgctaataccgaatacgctcccgattttatcattggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctccttt

SEQ ID NO: 319 - DNA, 1548 bp, Bilophila wadsworthia
ctggagagtttgattctggctcagattgaacgctggcggcgtgcttaacacatgcaagtcgaacgtgaaagtccttcggggcgagtaaagtggcgcacgggtgagtaacgcgtggataatctacccttaagatggggataacggctggaaacggtcgctaataccgaatacgctcccgattttatcgttggggggaaagatggcctctgcttgcaagctatcgcttaaggatgagtccgcgtcccattagctagttggcggggtaacggcccaccaaggcgacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctccttt

SEQ ID NO: 320 - DNA, 1548 bp, Bilophila wadsworthia; identical to SEQ ID NO: 318

SEQ ID NO: 321 - DNA, 1548 bp, Bilophila wadsworthia; identical to SEQ ID NO: 319

SEQ ID NO: 322 - DNA, 1561 bp, Veillonella parvula
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaacagttagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctccttt

SEQ ID NO: 323 - DNA, 1527 bp, Lachnospiraceae_bacterium_3_1_57FAA_CT1; identical to SEQ ID NO: 146

SEQ ID NO: 324 - DNA, 1527 bp, Lachnospiraceae_bacterium_3_1_57FAA_CT1; identical to SEQ ID NO: 147

SEQ ID NO: 325 - DNA, 1527 bp, Lachnospiraceae_bacterium_3_1_57FAA_CT1; identical to SEQ ID NO: 148

SEQ ID NO: 326 - DNA, 1536 bp, Erysipelotrichaceae_bacterium_2_2_44A; identical to SEQ ID NO: 156

SEQ ID NO: 327 - DNA, 1526 bp, Rothia_mucilaginosa
acggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagaaattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggggcttaactccgtgtattgcagtgggtacgggcagactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgttatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaacccttcggggagggagccgtctaaggtgggattggcgattgggactaagtcgtaacaaggtagccgtaccggaaggtgcggctggatcacctccttt

SEQ ID NO: 328 - DNA, 1563 bp, Lactobacillus rhamnosus
tatgagagtttgatcctggctcaggatgaacgctggcggcgtgcctaatacatgcaagtcgaacgagttctgattattgaaaggtgcttgcatcttgatttgattttgaacgagtggcggacgggtgagcaacacgtgggtaactgcccttagtgggggatacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgtatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctt

SEQ ID NO: 329 - DNA, 1567 bp, Lactobacillus rhamnosus
tatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgaatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgtatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctt

SEQ ID NO: 330 - DNA, 993 bp, Klebsiella oxytoca
ttgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagcttgtaggtgaggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtgaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatc

SEQ ID NO: 331 - DNA, 1510 bp, Clostridium perfringens
attgagagtttgatcctggctcaggatgaacgctggcggcgtgcttaacacatgcaagtcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaaatcccttcggggacaaggtgacaggtggtgcatggttgtcgtcagctcgtgtcgtgagatgttgggttaagtcccgcaacgagcgcaacccttgtcgttagttactaccattaagttgaggactctagcgagactgcctgggttaaccaggaggaaggtggggatgacgtcaaatcatcatgccccttatgtgtagggctacacacgtgctacaatggctggtacagagagatgcaataccgcgaggtggagccaaacttaaaaaccagtctcagttcggattgtaggctgaaactcgcctacatgaagctggagttactagtaatcgcgaatcagaatgtcgcggtgaatacgttcccgggtcttgtacacaccgcccgtcacaccatgagagttggcaatacccgaagtccgtgagctaaccgcaaggaggcagcggccgaaggtagggtcagcgattggggtgaagtcgtaacaaggtagccgtaggagaacctgcggctggatcacctccttt

SEQ ID NO: 332 - DNA, 1543 bp, Streptococcus_mitis_oralis_pneumoniae
taatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctt

SEQ ID NO: 333 - DNA, 1244 bp, Bacteroides ovatus
cgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggccccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 334 - DNA, 1526 bp, Bacteroides ovatus
atgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactccggaatagcctttcgaaagaaagattaataccggatagcatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggccccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 335 - DNA, 1525 bp, Bacteroides ovatus
atgaagagtttgatcctggctcaggatgaacgctagctacaggcttaacacatgcaagtcgaggggcagcattttagtttgcttgcaaactgaagatggcgaccggcgcacgggtgagtaacacgtatccaacctgccgataactccggaatagcctttcgaaagaaagattaataccggatagcatacgaatatcgcatgatatttttattaaagaatttcggttatcgatggggatgcgttccattagtttgttggcggggtaacggcccaccaagactacgatggataggggttctgagaggaaggtcccccacattggaactgagacacggtccaaactcctacgggaggcagcagtgaggaatattggtcaatgggcgagagcctgaaccagccaagtagcgtgaaggatgaaggctctatgggtcgtaaacttcttttatatgggaataaagttttccacgtgtggaattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgtcactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggttatgctgaggactctagagagactgccgtcgtaagatgtgaggaaggtggggatgacgtcaaatcagcacggcccttacgtccggggctacacacgtgttacaatggggggtacagaaggcagctacacggcgacgtgatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 336 - DNA, 1525 bp, Bacteroides ovatus
atgaagagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattttctccgcatggtgagaatattaaagaatttcggttatcgatggggatgcgttccattagtttgttggcggggtaacggcccaccaagaccacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaagtgttccacgtgtgggattttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactagactgttactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcaacagaatatattggaaacagtatagccgtaaggctgttgtgaaggtgctgcatggttgtcgtcagctcgtgccgtgaggtgtcggcttaagtgccataacgagcgcaacccttatctttagttactaacaggtcatgctgaggactctagagagactgccgtcgtaagatgtgaggaaggtggggatgacgtcaaatcagcacggcccttacgtccggggctacacacgtgttacaatggggggtacagaaggcggctacctggtgacaggatgctaatcccaaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcaaggagcgtcctagggtaaaactggtaattggggctaagtcgtaacaaggtagccgtaccggaaggtgcggctggaacacctcctt

SEQ ID NO: 337 - DNA, 1202 bp, Bacteroides uniformis; identical to SEQ ID NO: 192

SEQ ID NO: 338 - DNA, 1523 bp, Bacteroides uniformis; identical to SEQ ID NO: 193

SEQ ID NO: 339 - DNA, 1202 bp, Bacteroides uniformis; identical to SEQ ID NO: 192

SEQ ID NO: 340 - DNA, 1523 bp, Bacteroides uniformis; identical to SEQ ID NO: 195

SEQ ID NO: 341 - DNA, 1523 bp, Bacteroides uniformis; identical to SEQ ID NO: 193

SEQ ID NO: 342 - DNA, 1523 bp, Bacteroides uniformis; identical to SEQ ID NO: 195

SEQ ID NO: 343 - DNA, 1523 bp, Bacteroides uniformis; identical to SEQ ID NO: 195

SEQ ID NO: 344 - DNA, 1051 bp, Bacteroides vulgatus; identical to SEQ ID NO: 199

SEQ ID NO: 345 - DNA, 1524 bp, Bacteroides vulgatus; identical to SEQ ID NO: 200

SEQ ID NO: 346 - DNA, 1524 bp, Bacteroides vulgatus; identical to SEQ ID NO: 201

SEQ ID NO: 347 - DNA, 1524 bp, Bacteroides vulgatus; identical to SEQ ID NO: 202

SEQ ID NO: 348 - DNA, 1524 bp, Bacteroides vulgatus; identical to SEQ ID NO: 203

SEQ ID NO: 349 - DNA, 1054 bp, Bacteroides vulgatus; identical to SEQ ID NO: 204

SEQ ID NO: 350 - DNA, 1535 bp, Eubacterium_sp_3_1_31; identical to SEQ ID NO: 205

SEQ ID NO: 351 - DNA, 1535 bp, Eubacterium_sp_3_1_31; identical to SEQ ID NO: 205

SEQ ID NO: 352 - DNA, 1535 bp, Eubacterium_sp_3_1_31; identical to SEQ ID NO: 207

SEQ ID NO: 353 - DNA, 1535 bp, Eubacterium_sp_3_1_31; identical to SEQ ID NO: 208

SEQ ID NO: 354 - DNA, 1535 bp, Eubacterium_sp_3_1_31; identical to SEQ ID NO: 209

SEQ ID NO: 355 - DNA, 1398 bp, Morganella morganii
ggggataactactggaaacggtagctaataccgcataatgtcttcggaccaaagcgggggacctccgggcctcgcgccatcagatgaacccatatgggattagctagtaggtgaggtaacggcttacctaggcgacgatccctagctggtctgagaggatgatcagccacactgggactgagacacggcccagactcctacgggaggcagcagtggggaatattgcacaatgggcgcaagcctgatgcagccatgccgcgtgtatgaagaaggccttcgggttgtaaagtactttcagtcgggaggaaggtgtcaaggttaataaccttggcaattgacgttaccgacagaagaagcaccggctaactccgtgccagcagccgcggtaatacggagggtgcaagcgttaatcggaattactgggcgtaaagcgcacgcaggcggttgattgagtcagatgtgaaatccccgggcttaacccgggaattgcatctgatactggtcagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgtatacaaagggaagcgaccccgcgagggcaagcggaactcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctcctt

SEQ ID NO: 356 - DNA, 1521 bp, Parabacteroides_distasonis; identical to SEQ ID NO: 217

SEQ ID NO: 357 - DNA, 1521 bp, Parabacteroides_distasonis; identical to SEQ ID NO: 218

SEQ ID NO: 358 - DNA, 1521 bp, Parabacteroides_distasonis; identical to SEQ ID NO: 219

SEQ ID NO: 359 - DNA, 1521 bp, Parabacteroides_distasonis; identical to SEQ ID NO: 220

SEQ ID NO: 360 - DNA, 1521 bp, Parabacteroides_distasonis; identical to SEQ ID NO: 221

SEQ ID NO: 361 - DNA, 1535 bp, Citrobacter freundii
attggagagtttgatcctggctcaggacgaacgctggcggcgtgcctaatacatgcaagtcgagcgagtcccttcgggggctagcggcggacgggtgagtaacacgtaggcaacctgcctctcagactgggataacatagggaaacttatgctaataccggataggtttttggatcgcatgatctgaaaagaaaagatggcttttcgctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggacgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctccttt

SEQ ID NO: 362 - DNA, 1538 bp, Citrobacter freundii
ttgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 363 - DNA, 1544 bp, Lactococcus lactis
atttgagagtttgatcctggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctt

SEQ ID NO: 364 - DNA, 1544 bp, Lactococcus lactis; identical to SEQ ID NO: 363

SEQ ID NO: 365 - DNA, 1525 bp, Alistipes_onderdonkii
atggagagtttgatcctggctcaggatgaacgctagcggcaggcctaacacatgcaagtcgaggggcatcgggattgaagcttgcttcaattgccggcgaccggcgcacgggtgcgtaacgcgtatgtaacctacctataacaggggcataacactgagaaattggtactaattccccataatattcggagaggcatctctccgggttgaaaactccggtggttatagatggacatgcgttgtattagctagttggtgaggtaacggctcaccaaggcaacgatacatagggggactgagaggttaaccccccacactggtactgagacacggaccagactcctacgggaggcagcagtgaggaatattggtcaatggacgcaagtctgaaccagccatgccgcgtgcaggaagacggctctatgagttgtaaactgcttttgtacgagggtaaactcacctacgtgtaggtgactgaaagtatcgtacgaataaggatcggctaactccgtgccagcagccgcggtaatacggaggattcaagcgttatccggatttattgggtttaaagggtgcgtaggcggtttgataagttagaggtgaaatcccggggcttaactccggaactgcctctaatactgttagactagagagtagttgcggtaggcggaatgtatggtgtagcggtgaaatgcttagagatcatacagaacaccgattgcgaaggcagcttaccaaactatatctgacgttgaggcacgaaagcgtggggagcaaacaggattagataccctggtagtccacgcagtaaacgatgataactcgttgtcggcgatacacagtcggtgactaagcgaaagcgataagttatccacctggggagtacgttcgcaagaatgaaactcaaaggaattgacgggggcccgcacaagcggaggaacatgtggtttaattcgatgatacgcgaggaaccttacccgggcttgaaagttactgacgattctggaaacaggatttcccttcggggcaggaaactaggtgctgcatggttgtcgtcagctcgtgccgtgaggtgtcgggttaagtcccataacgagcgcaacccctaccgttagttgccatcaggtcaagctgggcactctggcgggactgccggtgtaagccgagaggaaggtggggatgacgtcaaatcagcacggcccttacgtccggggctacacacgtgttacaatggtaggtacagagggtcgctaccccgcgaggggatgccaatctcgaaagcctatctcagttcggattggaggctgaaacccgcctccatgaagttggattcgctagtaatcgcgcatcagccatggcgcggtgaatacgttcccgggccttgtacacaccgcccgtcaagccatggaagctgggggtgcctgaagttcgtgaccgcaaggagcgacctagggcaaaaccggtaactggggctaagtcgtaacaaggtagccgtaccggaaggtgcggctggaacacctccttt

SEQ ID NO: 366 - DNA, 1525 bp, Alistipes_onderdonkii; identical to SEQ ID NO: 365

SEQ ID NO: 367 - DNA, 1647 bp, Campylobacter curvus
atggagagtttgatcctggctcagagtgaacgctggcggcgtgcctaatacatgcaagtcgaacggacaagtaagagcttgctcttatgagttagtggcgcacgggtgagtaatgtatagctaatctgccccatagtggaggacaacagttggaaacgactgctaatactccatactccatttatatataagtataaatgggaaagtcgaaccctatatattgtttatttatcaaatacctacggcgcaaccgaaagttgcggtgtgctttaggtgggtcaagggagcgtagctccttgtcgcaaagacggactttgttcgtctgcgaagtaaataatatatagggtttctcgctatgggatgaggctatatcgtatcagctagttggtaaggtaatggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttggggaagaaatttgacggtacccaaggaataagcaccggctaactccgtgccagcagccgcggtaatacggagggtgcaagcgttactcggaatcactgggcgtaaaggacgcgtaggcggattatcaagtctcttgtgaaatccaatggcttaaccattgaactgcttgagaaactgataatctagagtgagggagaggtagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctgagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcgtatacaatgagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctt

SEQ ID NO: 368 - DNA, 1573 bp, Lactobacillus fermentum; identical to SEQ ID NO: 234

SEQ ID NO: 369 - DNA, 1573 bp, Lactobacillus fermentum; identical to SEQ ID NO: 235

SEQ ID NO: 370 - DNA, 1573 bp, Lactobacillus fermentum; identical to SEQ ID NO: 236

SEQ ID NO: 371 - DNA, 1572 bp, Lactobacillus fermentum; identical to SEQ ID NO: 237

SEQ ID NO: 372 - DNA, 1572 bp, Lactobacillus fermentum; identical to SEQ ID NO: 238

SEQ ID NO: 373 - DNA, 1137 bp, Bacteroides thetaiotaomicron; identical to SEQ ID NO: 239

SEQ ID NO: 374 - DNA, 1137 bp, Bacteroides thetaiotaomicron; identical to SEQ ID NO: 239

SEQ ID NO: 375 - DNA, 1525 bp, Bacteroides thetaiotaomicron; identical to SEQ ID NO: 241

SEQ ID NO: 376 - DNA, 1525 bp, Bacteroides thetaiotaomicron; identical to SEQ ID NO: 242

SEQ ID NO: 377 - DNA, 1569 bp, Lactobacillus gasseri
atgagagtttgatcctggctcaggacgaacgctggcggcgtgcctaatacatgcaagtcgagcgagcttgcctagatgaatttggtgcttgcaccaaatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggagttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctccttt

SEQ ID NO: 378 - DNA, 1566 bp, Lactobacillus_casei_paracasei
tatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctt

SEQ ID NO: 379 - DNA, 1566 bp, Lactobacillus_casei_paracasei; identical to SEQ ID NO: 378

SEQ ID NO: 380 - DNA, 1557 bp, Enterococcus faecium
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctccttt

SEQ ID NO: 381 - DNA, 1566 bp, Lactobacillus_casei_paracasei; identical to SEQ ID NO: 378

SEQ ID NO: 382 - DNA, 1566 bp, Lactobacillus_casei_paracasei
tatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggttaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctt

SEQ ID NO: 383 - DNA, 1566 bp, Lactobacillus_casei_paracasei
tatgagagtttgatcctggctcaggatgaacgctggcggcgtgcctaatacatgcaagtcgaacgagttctcgttgatgatcggtgcttgcactgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctt

SEQ ID NO: 384 - DNA, 1566 bp, Lactobacillus_casei_paracasei; identical to SEQ ID NO: 378

SEQ ID NO: 385 - DNA, 1567 bp, Lactobacillus_casei_paracasei
tatgagagtttgatcctggctcaggatgaacgctggcggcgtgcctaatacatgcaagtcgaacgagttctcgttgatgatcggtgcttgcaccgagattcaacatagaacgagtggcggacgggtgagtaacacgtgggtaacctgcccttaagtgggggataacatttggaaacagatgctaataccgcatagatccaagaaccgcatggttcctggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctccttt

SEQ ID NO: 386 - DNA, 1563 bp, Lactobacillus plantarum
tttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttctggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagcaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctt

SEQ ID NO: 387 - DNA, 1441 bp, Enterobacter cloacae
agcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgaggttaataacctcagcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 388 - DNA, 1538 bp, Escherichia coli
ttgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaaccttgtagagatacgagggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 389 - DNA, 1538 bp, Escherichia coli
ttgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 390 - DNA, 1538 bp, Escherichia coli; identical to SEQ ID NO: 389

SEQ ID NO: 391 - DNA, 1538 bp, Escherichia coli; identical to SEQ ID NO: 389

SEQ ID NO: 392 - DNA, 1538 bp, Escherichia coli; identical to SEQ ID NO: 389

SEQ ID NO: 393 - DNA, 1538 bp, Escherichia coli
ttgaagagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaaccttgtagagatacgagggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 394 - DNA, 1538 bp, Escherichia coli; identical to SEQ ID NO: 393

SEQ ID NO: 395 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 396 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 397 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 398 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 399 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 400 - DNA, 1536 bp, Klebsiella pneumoniae; identical to SEQ ID NO: 395

SEQ ID NO: 401 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagcttgtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 402 - DNA, 1536 bp, Klebsiella pneumoniae
ttgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctcctt

SEQ ID NO: 403 - DNA, 1255 bp, Fusobacterium nucleatum
gctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctt

SEQ ID NO: 404 - DNA, 1521 bp, Butyrivibrio_sp.; identical to SEQ ID NO: 260

SEQ ID NO: 405 - DNA, 1177 bp, Ruminococcus obeum; identical to SEQ ID NO: 267

What is claimed is:

1. A method of reducing an abundance of at least one antibiotic-resistance gene in the microbiome of a mammalian subject in need thereof, comprising administering to the subject a therapeutically effective amount of a composition comprising a combination of bacteria, the combination comprising *Blautia wexlerae* and *Anaerotruncus colihominis*, wherein after the administration of the composition, the abundance of the at least one antibiotic-resistance gene in the microbiome of the subject is reduced as compared to a corresponding subject who did not receive the administration of the composition, wherein the at least one antibiotic-resistance gene is capable of conferring resistance to beta-lactam antibiotics and at least one additional antibiotic drug class, and wherein:

(a) the *Blautia wexlerae* comprises a 16S rDNA sequence that is at least 97% identical to the 16S rDNA sequence set forth in any one of SEQ ID NOs: 104-110 and 255; and (b) the *Anaerotruncus colihominis* comprises a 16S rDNA sequence that is at least 97% identical to the 16S rDNA sequence set forth in any one of SEQ ID NOs: 89-92.

2. A method of treating a mammalian subject at risk for or diagnosed with an undesirable level of bacteria that are resistant to multiple antibiotic drug classes, comprising administering to the subject a therapeutically effective amount of a composition comprising a combination of bacteria, wherein the combination comprises *Blautia wexlerae* and *Anaerotruncus colihominis*, wherein the undesirable level is a level significantly greater than that in a healthy subject population and the multiple antibiotic drug classes comprise beta-lactam antibiotics and at least one additional antibiotic drug class, and wherein:

(a) the *Blautia wexlerae* comprises a 16S rDNA sequence that is at least 97% identical to the 16S rDNA sequence set forth in any one of SEQ ID NOs: 104-110 and 255; and (b) the *Anaerotruncus colihominis* comprises a 16S rDNA sequence that is at least 97% identical to the 16S rDNA sequence set forth in any one of SEQ ID NOs: 89-92.

3. The method of claim 1, wherein the composition comprises 3, 4, 5, 6, 7, 8, 9, 10, 11, 12, 13, 14, 15, 16, 17, 18, 19, 20 or more bacterial species.

4. The method of claim 1, wherein the bacteria are in a spore form, a vegetative form, or a mixed vegetative form and spore form.

5. The method of claim 1, wherein, prior to the administration, the subject has been unresponsive to antibiotic treatment, has or is at risk of developing *Clostridium difficile* infection, or has or is at risk of developing colitis.

6. The method of claim 1, wherein:

(a) the *Blautia wexlerae* comprises a 16S rDNA sequence that is at least 98% identical to the 16S rDNA sequence set forth in any one of SEQ ID NOs: 104-110 and 255; and (b) the *Anaerotruncus colihominis* comprises a 16S rDNA sequence that is at least 98% identical to the 16S rDNA sequence set forth in any one of SEQ ID NOs: 89-92.

7. The method of claim 1, wherein:

(a) the *Blautia wexlerae* comprises a 16S rDNA sequence that is at least 99% identical to the 16S rDNA sequence set forth in any one of SEQ ID NOs: 104-110 and 255; and (b) the *Anaerotruncus colihominis* comprises a 16S rDNA sequence that is at least 99% identical to the 16S rDNA sequence set forth in any one of SEQ ID NOs: 89-92.

8. The method of claim 1, wherein:

(a) the *Blautia wexlerae* comprises the 16S rDNA sequence set forth in any one of SEQ ID NOs: 104-110 and 255; and (b) the *Anaerotruncus colihominis* comprises the 16S rDNA sequence set forth in any one of SEQ ID NOs: 89-92.

9. The method of claim 2, wherein:

(a) the *Blautia wexlerae* comprises a 16S rDNA sequence that is at least 98% identical to the 16S rDNA sequence set forth in any one of SEQ ID NOs: 104-110 and 255; and (b) the *Anaerotruncus colihominis* comprises a 16S rDNA sequence that is at least 98% identical to the 16S rDNA sequence set forth in any one of SEQ ID NOs: 89-92.

10. The method of claim 2, wherein:

(a) the *Blautia wexlerae* comprises a 16S rDNA sequence that is at least 99% identical to the 16S rDNA sequence set forth in any one of SEQ ID NOs: 104-110 and 255; and (b) the *Anaerotruncus colihominis* comprises a 16S rDNA sequence that is at least 99% identical to the 16S rDNA sequence set forth in any one of SEQ ID NOs: 89-92.

11. The method of claim 2, wherein:

(a) the *Blautia wexlerae* comprises the 16S rDNA sequence set forth in any one of SEQ ID NOs: 104-110 and 255; and (b) the *Anaerotruncus colihominis* comprises the 16S rDNA sequence set forth in any one of SEQ ID NOs: 89-92.

12. The method of claim 2, wherein the composition comprises 3, 4, 5, 6, 7, 8, 9, 10, 11, 12, 13, 14, 15, 16, 17, 18, 19, 20 or more bacterial species.

13. The method of claim 2, wherein the bacteria are in a spore form, a vegetative form, or a mixed vegetative form and spore form.

14. The method of claim 1, wherein the bacteria are cultured.

15. The method of claim 2, wherein the bacteria are cultured.

16. The method of claim 1, wherein the composition is administered to the subject via oral delivery, colonoscopic delivery, or nasogastric delivery.

17. The method of claim 2, wherein the composition is administered to the subject via oral delivery, colonoscopic delivery, or nasogastric delivery.

18. The method of claim 1, wherein the abundance of 2, 3, 4, 5, 6, 7, 8, 9, 10, or more antibiotic-resistance genes in the microbiome of the subject is reduced as compared to the corresponding subject who did not receive the administration of the composition.

19. The method of claim 1, wherein the at least one additional antibiotic drug class is selected from aminocoumarin antibiotic, aminoglycoside antibiotic, cephalosporin, cephamycin, fluoroquinolone antibiotic, glycylcycline, macrolide antibiotic, nitroimidazole antibiotic, nucleoside antibiotic, penam, peptide antibiotic, phenicol antibiotic, rifamycin antibiotic, benzalkonium chloride, monobactam, penem, streptogramin antibiotic, rhodamine, triclosan, lincosamide antibiotic, acridine dye, carbapenem, tetracycline antibiotic, and fosfomycin.

20. The method of claim 2, wherein the at least one additional antibiotic drug class is selected from aminocoumarin antibiotic, aminoglycoside antibiotic, cephalosporin, cephamycin, fluoroquinolone antibiotic, glycylcycline, macrolide antibiotic, nitroimidazole antibiotic, nucleoside antibiotic, penam, peptide antibiotic, phenicol antibiotic, rifamycin antibiotic, benzalkonium chloride, monobactam, penem, streptogramin antibiotic, rhodamine, triclosan, lincosamide antibiotic, acridine dye, carbapenem, tetracycline antibiotic, and fosfomycin.

* * * * *